United States Patent 10,760,088 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 6

SEQ ID NO: 13891 - protein, 485 aa, Eucalyptus grandis
MALIVEKTAGGREYKVKDMSQADFGRLEIELAEVEMPGLMACRAEYGPAQPFKGARITGSLHMTIQTAVLIETLTALGAEVRWCSCNIFSTQDHAAAATARDSAAVFAWKGETLQEYWWCTERALDWGPGGGPDLIVDDGGDATLLIHEGVKAEEEFEKTGKVPDPASTDNAEFQIVLTIIKDGLKADPKKYRKMRDRLVGVSEETTTGVKRLYQMQQNGTLLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVHHMKKMKNNAIVCNIGHFDNEIDMLGLETFPGVKRITIKPQTDRWVFPDTKSGIIVLAEGRLMNLGCATGHPSFVMSCSFTNQVIAQLELWKEKATGKYEKKVYVLPKHLDEKVAALHLGKLGAKLTKLSKDQADYISVPVEGPYKPPHYRY

SEQ ID NO: 13892 - protein, 485 aa, Olea europaea
MALFVEKTTSGREYKVKDMSQADFGRLEIELAEVEMPGLMSCRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKTGKVPDPNSTDNAEFQIVLTIIRDGLKSDPKKYTRMKKRLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMKKMKNNAIVCNIGHFDNEIDMHGLETYPGVKRITIKPQTDRWVFPETKSGIIVLAEGRLMNLGCATGHPSFVMSCSFTNQVIAQLELWNERKTGKYEKKVYVLPKHLDEKVAALHLGKLGAKLTELSKDQADYISVPVEGPYKPPRYRY

SEQ ID NO: 13893 - protein, 485 aa, Solanum lycopersicum
MALIVEKTTSGREYKVKDMSQADFGRLEIELAEVEMPGLMACRTEFGPSQPFKGAKITGSLHMTIQTAVLIETLTALGAEVRWCSCNIFSTQDHAAAATARDSAAVFAWKGETLQEYWWCTERALDWGPGGGPDLIVDDGGDATLLIHEGVKAEEEYAKTGKFPDPNSTDNVEFQLVLTIIKDGLKSDPLKYTKMKERLVGVSEETTTGVKRLYQMQANGTLLFPAINVNDSVTKSKFDNLYGCRHSLPDGLMRATDVMIAGKVALIAGYGDVGKGCAAAMKQAGARVIVTEIDPICALQATMEGLQVLPLEDVVSEIDIFVTTTGNKDIIMVDHMRKMKNNAIVCNIGHFDNEIDMLGLETYPGVKRITIKPQTDRWVFPDTKSGIIVLAEGRLMNLGCATGHPSFVMSCSFTNQVIAQLELWKEKASGKYEKKVYVLPKHLDEKVAALHLGQLGVKLTKLSKDQADYISVPVEGPYKPAHYRY

SEQ ID NO: 13894 - protein, 485 aa, Tripterygium wilfordii
MALLVEKTAGGREYKVKDMSLADFGRLEIDLAEVEMPGLMSCRTEYGPSQPFKGAKITGSLHMTIQTAVLIETLTALGAEVRWCSCNIFSTQDHAAAAIARDIAAVFAWKGETLQEYWWCTERALDWGPGGGPDLIVDDGGDATLLIHEGVKAEEIYEKTGTLPDPASIDNAEFQIVLTIIRDGLKTDPKKYHKMKERLVGVSEETTTGVKRLYQMQINGTLLFPAINVNDSVTKSKFDNLYGCRHSLPDGLMRASDVMIAGKVGVVCGYGDVGKGCAAALKQAGARVIVTEIDPICALQALMEGYQVLTLEDVLSEADIFVTTTGNKDIIMVDHMRKMKNNAIVCNIGHFDNEIDMLGLETFPGVKRITIKPQTDRWVFPDTNLGIIVLAEGRLMNLGCATGHPSFVMSCSFTNQVIAQLELWMEKSTGKYEKKVYVLPKHLDEKVAALHLGKLGARLTKLSKDQADYISVPVEGPYKPAHYRY

SEQ ID NO: 13895 - protein, 485 aa, Mimulus guttatus
MALLVEKTTSGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKNGTVPDPNSTDNAEFQIVLTIIRDGLKTDPKRYTKMKERLVGVSEETTTGVKRLYQMQANGTLLFPAINVNDSVTKSKFDNLYGCRHSLPDGLMRATDVMIAGKVGVVCGYGDVGKGCAISLKQAGARVIVTEIDPICALQALMEGFQVLTLEDVLSEADIFVTTTGNKDIIMVDQMKRMKNNAIVCNIGHFDNEIDMQGLENYPGVKRITIKPQTDRWVFPETKSGIIVLAEGRLMNLGCATGHPSFVMSCSFTNQVIAQLELWNERKSGKYGKEVYVLPKHLDEKVAALHLGKLGAKLTKLTKDQSDYISIPVEGPYKPPHYRY

SEQ ID NO: 13896 - protein, 485 aa, Solanum tuberosum
MALLVEKTTSGREYKVKDMSQADFGRLEIELAEVEMPGLMASRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPTSTDNVEFQLVLTIIKESLKTDPLRYTKMKERLVGVSEETTTGVKRLYQMQANGTLLFPAINVNDSVTKSKFDNLYGCRHSLPDGLMRATDVMIAGKVALVAGYGDVGKGCAAAMKQAGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPDTNSGIIVLAEGRLMNLGCATGHPSFVMSCSFTNQVIAQLELWNERTSGKYEKKVYVLPKHLDEKVAALHLGKLGAKLTKLTKDQADYISVPVEGPYKPAHYRY

SEQ ID NO: 13897 - protein, 485 aa, Coffea canephora
MALLVEKTTSGREYKVKDMSQADFGRLEIELAEVEMPGLMSCRAEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYKKSGKLPDPASTDNAEFQIVLTIIRDGLKTDPTKYAKMKERLVGVSEETTTGVKRLYQMQANGTLLFPAINVNDSVTKSKFDNLYGCRHSLPDGLMRATDVMIAGKVGVVCGYGDVGKGCAAALKQAGARVIVTEIDPICALQALMEGFQVLTLEDVVSEADIFVTTTGNKDIIMVSHMKKMKNNAIVCNIGHFDNEIDMLGLETYPGVKRITIKPQTDRWVFPETKSGIIVLAEGRLMNLGCATGHPSFVMSCSFTNQVIAQLELWKEKSTGKYEKKVYVLPKHLDEKVAALHLGKLGAKLTKLSKDQADYISVPVEGPYKPPHYRY

SEQ ID NO: 13898 - protein, 485 aa, Setaria italica
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKVPDPESTDNAEFKIVLTIIRDGLKSDPKRYRKMKERLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLSKSQSDYISVPIEGPYKPAHYRY

SEQ ID NO: 13899 - protein, 485 aa, Solanum phureja
MALIVEKTTSGREYKVKDMSQADFGRLEIELAEVEMPGLMACRTEFGPSQPFKGAKITGSLHMTIQTAVLIETLTALGAEVRWCSCNIFSTQDHAAAATARDSAAVFAWKGETLQEYWWCTERALDWGPGGGPDLIVDDGGDATLLIHEGVKAEEEYAKTGKFPDPHSTDNVEFQLVLTIIKDGLKSDPLKYTKMKERLVGVSEETTTGVKRLYQMQANGTLLFPAINVNDSVTKSKFDNLYGCRHSLPDGLMRATDVMIAGKVALIAGYGDVGKGCAAAMKQAGARVIVTEIDPICALQATMEGLQVLPLEDVVSEIDIFVTTTGNKDIIMVDHMRKMKNNAIVCNIGHFDNEIDMLGLETYPGVKRITIKPQTDRWVFPDTKSGIIVLAEGRLMNLGCATGHPSFVMSCSFTNQVIAQLELWKEKASGKYEKKVYVLPKHLDEKVAALHLGQLGVKLTKLSKDQADYISVPVEGPYKPAHYRY

SEQ ID NO: 13900 - protein, 485 aa, Artemisia annua
MSLTVEKTTSGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERSLDWGPGGGPDLIVDDGGDATLLIHEGVKAEEEFAKSGKLPDPTSTDNAEFQIVLSIIKEGLSTDPLKYHKMKERLVGVSEETTTGVKRLYQMQANGTLLFPAINVNDSVTKSKFDNLYGCRHSLPDGLMRATDVMIAGKVAVVCGYGDVGKGCASAMKQAGARVIVTEIDPICALQATMEGLQVLTLEDVVSEADIFVTTTGNKDIIMVDDMRKMKNNAIVCNIGHFDNEIDMLGLETYPGVKRITIKPQTDRWVFPETKSGVIILAEGRLMNLGCATGHPSFVMSCSFTNQVIAQLELWNEKGTGKYKNEVYVLPKHLDEKVAALHLGKLGAKLTKLTKDQSDYLSIPIEGPYKPAAYRY

SEQ ID NO: 13901 - protein, 485 aa, Helianthus annuus
MALTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPTSTDNAEFQIVLSIIKEGLATDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVVSEADIFVTTTGNKDIIMVSDMKKMKNNAIVCNIGHFDNEIDMLGLETYPGVQRITIKPQTDRWVFPETKTGIIVLAEGRLMNLGCATGHPSFVMSCSFTNQVIAQLELWNEKNTGKYKKEVYVLPKHLDEKVAALHLGKLGAKLTKLTKDQADYISVPVEGPYKPAHYRY

SEQ ID NO: 13902 - protein, 485 aa, Cucumis sativus
MSLIVEKTAAGREYKVKDMSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKTGALPDPASTDNAEFQIVLTIIRDGLKSDPKRYHKMKERLVGVSEETTTGVKRLYQMQSSGTLLFPAINVNDSVTKSKFDNLYGCRHSLPDGLMRATDVMIAGKVAVVCGYGDVGKGCAAALKQAGARVIVTEIDPICALQALMEGLQVLTLEDAVSEADIFVTTTGNKDIIMVDHMRKMKNNAIVCNIGHFDNEIDMLGLENYPGVKRITIKPQTDRWVFPETNVGIIVLAEGRLMNLGCATGHPSFVMSCSFTNQVIAQLELWNERASGKYEKKVYVLPKHLDEKVAALHLGKLGAKLTKLSKDQADYINVPVEGPYKPAHYRY

SEQ ID NO: 13903 - protein, 485 aa, Flaveria ramosissima
MSLTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKSGKLPDPNSTDNAEFQIVLSIIKEGLQSDPKKYHRMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYKKEVYVLPKHLDEKVAALHLGKLGAKLTKLSQDQADYISVPVEGPYKPAHYRY

SEQ ID NO: 13904 - protein, 485 aa, Flaveria ramosissima
MSLTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKSGKLPDPTSTDNAEFQIVLSIIKEGLQSDPKKYHRMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYKKEVYVLPKHLDEKVAALHLGKLGAKLTKLSQDQADYISVPVEGPYKPAHYRY

SEQ ID NO: 13905 - protein, 485 aa, Lotus japonicus
MALVVEKTTSGREYKVKDMTQADFGRLEIDLAEVEMPGLISCRTEFGPSQPFKGAKITGSLHMTIQTAVLIETLTALGAEVRWCSCNIFSTQDHAAAAIARDSAAVFAWKGETLQEYWWCTERALDWGPSGGPDLIVDDGGDATLLIHEGVKAEEVYEKDGTFPDPASTDNAEFQIVLTIIRDGLKTDPHRYRKMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVQTLEDAVSEADIFVTTTGNKDIIMVDHMRKMKNNAIISNIGHFDNEIDMHGLETYPGVKRITIKPQTDRWVFPDTNSGIIVLAEGRLMNLGCATGHPSFVMSCSFTNQVIAQLELWKEKGSGKYEKKVYVLPKHLDEKVAALHLGKLGARLTKLRKDQSDYISIPIEGPYKPAHYRY

SEQ ID NO: 13906 - protein, 485 aa, Triticum aestivum
MALSVEKTSSGREYKVKDLSQADFGRLELDLAEVEMPGLMACRTEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDAHKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNEKATGKYEKKVYVLPKHLDEKVAALHLGKLGARLTKLTKSQSDYISIPVEGPYKPAAYRY

SEQ ID NO: 13907 - protein, 485 aa, Zea mays
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLPLEDVVSEADIFVTTTGNKDIIMVDHMRKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRY

SEQ ID NO: 13908 - protein, 485 aa, Solanum phureja
MALLVEKTTSGREYKVKDMSQADFGRLEIELAEVEMPGLMASRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKNGTIPDPTSTDNVEFQLVLTIIKESLKTDPLRYTKMKERLVGVSEETTTGVKRLYQMQANGTLLFPAINVNDSVTKSKFDNLYGCRHSLPDGLMRATDVMIAGKVALVAGYGDVGKGCAAAMKQAGARVIVTEIDPICALQATMEGLQVLPLEDVVSEVDIFVTTTGNKDIIMVDHMRKMKNNAIVCNIGHFDNEIDMHGLETFPGVKRITIKPQTDRWVFPETNSGIIVLAEGRLMNLGCATGHPSFVMSCSFTNQVIAQLELWNERKSGKYEKKVYVLPKHLDEKVAALHLGKLGAKLTKLTKDQADYISVPVEGPYKPAHYRY

SEQ ID NO: 13909 - protein, 485 aa, Ocimum basilicum
MALQVEKTNSGREYKVKDMSQADFGRLEIELAEVEMPGLMSCRAEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKSGKLPDPSSTDNAEFQIVLTLIRDGLKADPSKYRKMKERLVGVSEETTTGVKRLYQMQANGTLLFPAINVNDSVTKSKFDNLYGCRHSLPDGLMRATDVMIAGKVGVVCGYGDVGKGCAAALKQAGARVIVTEIDPICALQALMEGFQVLTLEDVLADADIFVTTTGNKDIIMVDHMRKMKNNAIVCNIGHFDNEIDMQGLETYPGVKRITIKPQTDRWVFPETNTGIIVLAEGRLMNLGCATGHPSFVMSCSFTNQVIAQLELWKERSSGKYEKKVYVLPKHLDEKVAALHLGKLGAKLTKLTKDQADYISVPVEGPYKPPHYRY

SEQ ID NO: 13910 - protein, 485 aa, Gossypium hirsutum
MALSVEKTAAGREYKVKDMSQADFGRLEIELAEVEMPGLMACRAEFGPAQPFKGAKITGSLHMTIQTAVLIETLTALGAEVRWCSCNIFSTQDHAAAAIARDSAAVFAWKGETLQEYWWCTERALDWGPTGGPDLIVDDGGDATLLIHEGVKAEEVYEKTGQLPDPSSTDNAEFQIVLTIIRDGLKADPKKYTRMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVNHMRKMKNNAIVCNIGHFDNEIDMLGLENYPGVKRITIKPQTDRWVFPETNTGIIVLAEGRLMNLGCATGHPSFVMSCSFTNQVIAQLELWKEKATGKYEKKVYVLPKHLDEKVAALHLGKLGANLTKLTKDQADYISVPIEGPYKPPHYRY

SEQ ID NO: 13911 - protein, 485 aa, Eucalyptus grandis
MALSVEKTTGGREYKVKDMSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGKLPDPASTDNAEFQLVLTIIRDGLKTDPQRYHKMKDRLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLPLQDVVSEADIFVTTTGNKDIIMVHDMKKMKNNAIVCNIGHFDNEIDMHGLENFPGVKRITIKPQTDRWVFPDTKSGIIVLAEGRLMNLGCATGHPSFVMSCSFTNQVIAQLELWKEKSSGKYKKEVYVLPKHLDEKVAALHLGKLGAKLTKLSKEQADYISVPVEGPYKPPHYRY

SEQ ID NO: 13912 - protein, 485 aa, Helianthus annuus
MALTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPSSTDNAEFQIVLSIIKEGLATDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVFSEAYIFVTTTGNKDIIMVSDMKKMKNNAIVCNIGHFDNEIDMLGLETYPGVQRITIKPQTDRWVFPETKTGIIVLAEGRLMNLGCATGHPSFVMSCSFTNQVIAQLELWNEKNTGKYKKEVYVLPKHLDEKVAALHLGKLGAKLTKLTKDQADYISVPVEGPYKPAHYRY

SEQ ID NO: 13913 - protein, 485 aa, Prunus persica
MALSVEKSSSGREYKVKDMSQADFGRLEIELAEVEMPGLISCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKSGKLPDPASTDNQEFQLVLTIIRDGLKTDPKRYHKMKDRLVGVSEETTTGVKRLYQMQASGALLFPAINVNDSVTKSKFDNLYGCRHSLPDGLMRATDVMIAGKVSVVCGYGDVGKGCAAALKQAGSRVIVTEIDPICALQALMEGLQVLPLEDVVSEADIFVTTTGNKDIIMVEHMRKMKNNAIVCNIGHFDNEIDMHGLETYPGVKRITIKPQTDRWVFPETNTGIIILAEGRLMNLGCATGHPSFVMSCSFTNQVIAQLELWNERKSGKYEKKVYVLPKHLDEKVAALHLGKLGAKLTKLTKEQADYISVPVEGPYKPAHYRY

SEQ ID NO: 13914 - protein, 485 aa, Glycine max
MALLVEKTTSGREYKVKDLSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGELPDPNSTDNAEFQIVLTIIRDGLKTDPTRYRKMKERLVGVSEETTTGVKRLYQMQANGTLLFPAINVNDSVTKSKFDNLYGCRHSLPDGLMRATDVMIAGKVAVVAGYGDVGKGCAAAMKQAGARVIVTEIDPICALQALMEGLQVLTLEDVVSEADIFVTTTGNKDIIMVDHMRKMKNNAIVCNIGHFDNEIDMLGLENYPGVKRITIKPQTDRWVFPETNTGIIVLAEGRLMNLGCATGHPSFVMSCSFTNQVIAQLELWKEKSTGKYEKKVYVLPKHLDEKVAALHLGKLGAKLTQLSKSQADYISVPVEGPYKPAHYRY

SEQ ID NO: 13915 - protein, 485 aa, Ipomoea nil
MALTVEKTSSGREYKVKDMSQADFGRLELELAEVEMPGLMACRAEFGPSQPFKGARITGSLHMTIQTAVLIETLTALGAEVRWCSCNIFSTQDHAAAAVARDSAAVFAWKGETLQEYWWCTERALDWGPGGGPDLIVDDGGDATLLIHEGVKAEEEYAKNGTVPDPSSTDNAEFQIVLTIIRDGLKADPKKYTRMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVSHMKKMKNNAIVCNIGHFDNEIDMHGLETYPGVKRITIKPQTDRFVFPETKTGIIILAEGRLMNLGCATGHPSFVMSCSFTNQVIAQLELWKEKNTGKYEKKVYVLPKHLDEKVAALHLGKLGAKLTKLTPEQAAYISIPVEGPYKPPHYRY

SEQ ID NO: 13916 - protein, 485 aa, Helianthus annuus
MSLTVEKTSTGREYKVKDMSLADFGRLELELAEVEMPGLMSCKTEFGPSQPFKGARITGSLHMTIQTGVLIETLTALGAEVRWRSCNIFSTQDHAAAAIARDSAAVFAWKGETLQEYWWCTERALDWGPGGGPDLIVDDGGDATLLIHEGVKAEEEFAKTGKLPDPSSTDNAEFQIVLSIIKDGLQSDPKKYHKMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIIVTTTGNKDIIMVDHMKKMKNNAIVCNIGHFDNEIDMLGLETYPGVKRITIKPQTDRWVFPETNSGIIVLAEGRLMNLGCATGHPSFVMSCSFTNQVIAQLELWKEKATGKYKKEVYVLPKHLDEKVAALHLGKLGAKLTKLSQDQADYISVPVEGPYKPAQYRY

SEQ ID NO: 13917 - protein, 486 aa, Valeriana officinalis
MAALVAEKTASGREYKVKDMSLADFGRLELELAEVEMPGLMSCRTEFGPSQPFKGARITGSLHMTIQTGVLIETLTALGAEVRWCSCNIFSTQDHAAAAIARDSCAVFAWKGETLQEYWWCTERALDWGPGGGPDLIVDDGGDATLLIHEGVKAEEEFEKSGKIPDPTSTDNPEFQLVLTIIRDGLKTDPKKYHKMKDRLVGVSEETTTGVKRLYQMQANGTLLFPAINVNDSVTKSKFDNLYGCRHSLPDGLMRATDVMIAGKVAVICGYGDVGKGCASAMKQAGARVIVTEIDPICALQALMEGLQVLTLEDALSEADIFVTTTGNKDIIMVDHMRKMKNNAIVCNIGHFDNEIDMLGLETYPGVKRITIKPQTDRWVFPETKTGILVLAEGRLMNLGCATGHPSFVMSCSFTNQVIAQLELWKEKSSGKYEKKVYVLPKHLDEKVAALHLGQLGAKLTKLSKDQADYISVPIEGPYKPAHYRY

SEQ ID NO: 13918 - protein, 239 aa, Malus domestica
MKGSNLLIKVLGQDIHLLLVLAGLPLIPQLELSNHLVGERAGHHKAGVSSGTAQVHETALSQHNDAGFGLGEDPPVGLRLDGDALHSGVCLKTMHVNLIVKMTNVANNGIVLHLLHVVNHDDVLVTGGGNKDIGLSDNILKGKNLKAFHKSLEGTDWINLSHNHAGSSLLEGSSTTLSDISISTDNGNLSGNHNISGSHQTIGERVTASVQVVKLHTLLLVTESLTLMAGNKRAPLACI

SEQ ID NO: 13919 - protein, 407 aa, Taraxacum officinale
MALTVEKTSTGREYKVKDMSLADFGRLELELAEVEMPGLMSCRTEFGPSQPFKGARITGSLHMTIQTAVLIETLTALGAEVRWCSCNIFSTQDHAASAIARDSAAVFAWKGETLQEYWWCTERALDWGPGGGPDLIVDDGGDATLLIHEGVKAEEEFAKTGKLPDPTSTDNPEFQIVLSIIKEGLQSDPTKYHKMKDRLVGVSEETTTGVKRLYQMQANGTLLFPAIKVNDSVTKSKFDNLYGCRHSLPDGLMRATDVMIAGKVAVICGYGDVGQGCAAAMKQAGARVIVTEIDPICALQALMEGLQVLTLDDVLSEADIFVTTTGNKDIIMVDHMKKMKNNAIVCNIGHFDNEIDMLGLETYPGVKRITIKPQTDRWVFPDTKTGVIILAEGRLMTWGVLQGTLVL

SEQ ID NO: 13920 - protein, 485 aa, Arnica chamissonis
MAFIVEKTSSGREYKVKDMSLADFGRLELELAEVEMPGLMSCRTEFGPSQPFKGAKITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKNGKLPDPNSTDNAEFQIVLSIIKEGLQIDPKKYHKMKERLVGVSEETTTGVKRLYQMQANGSLLFPAINVNDSVTKSKFDNLYGCRHSLPDGLMRATDVMIAGKVAVVCGYGDVGKGCAAAMKQAGARVIVTEIDPICALQALMEGLQVLTLEDVVSEADIFVTTTGNKDIIMVEHMKKMKNNAIICNIGHFDNEIDMLGLETYPGVKRITIKPQTDRWVFPETKSGVIVLAEGRLMNLGCATGHPSFVMSCSFTNQVIAQLELWNEKGNGKYKNEVYVLPKHLDEKVAALHLGKLGARLTKLSKNQADYISVSVDGPYKPAHYRY

SEQ ID NO: 13921 - protein, 485 aa, Chelidonium majus
MALLVEKTASGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKSGAIPDPTSTDNAEFQIVLQIIKDGLKDDPKKYHKMKDRLVGVSEETTTGVKRLYQMQLNGTLLFPAINVNDSVTKSKFDNLYGCRHSLPDGLMRATDVMIAGKIALVAGYGDVGKGCAAALKQAGAQVIVTEIDPICALQALMEGIPVQRLEDVVSQVDIFVTTTGNKDIIMLEHMRKMKNNAIVCNIGHFDNEIDMLGLETFPGVKRITIKPQTDRWVFPDTKTGIIVLAEGRLMNLGCATGHPSFVMSCSFTNQVIAQLELWNEKASGKYEKKVYVLPKHLDEKVAALHLGKLGAKLTKLSKDQADYISVPVEGPYKPAHYRY

SEQ ID NO: 13922 - protein, 484 aa, Flaveria ramosissima
SLTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKSGKLPDPNSTDNAEFQIVLSIIKEGLQSDPKKYHRMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNTGIIVLAEGRLMNLGCATGHPSFVMSCSFTNQVIAQLELWKEKSSGKYKKEVYVLPKHLDEKVAALHLGKLGAKLTKLSQDQADYISVPVEGPYKPAHYRY

SEQ ID NO: 13923 - protein, 485 aa, Silene vulgaris
MSLIAERTSSGREYKVKDMSQADFGRLELELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGAAGGPDLIVDDGGDATLLIHEGVKAEEEFAKSGKIPDPNSTDNVEFQLVLGLIKESLKVDPKRYHKMKERLVGVSEETTTGVKRLYQMQENGTLLFPAINVNDSVTKSKFDNLYGCRHSLPDGLMRATDVMIAGKVGVVCGYGDVGKGCALALKAGGARVIVTEIDPICALQALMEGFQVLTLEDVVSEADIFVTTTGNKDIIMVDHMRKMKNNAIVCNIGHFDNEIDMHGLETFPGVKRITIKPQTDRFVFPDTKSGIIILAEGRLMNLGCATGHPSFVMSCSFTNQVIAQLELWKEKASGKYEKKVYVLPKHLDEKVAALHLGKLGAKLTKLSKDQSDYLSIPVEGPYKPAHYRY

SEQ ID NO: 13924 - protein, 485 aa, Vinca minor
MALLVEKTSSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYKKSGTIPDPNSTDNAEFQIVLTIIRDGLKSDPSKYTKMKERLVGVSEETTTGVKRLYQMQANGTLLFPAINVNDSVTKSKFDNLYGCRHSLPDGLMRATDVMIAGKVALVAGYGDVGKGCAAALKQAGARVIVTEIDPICALQATMEGLQVLTLKDVVSDVDIFVTTTGNKDIIMVDDMKKMKNNAIVCNIGHFDNEIDMLGLESYPGVKRITIKPQTDRWVFPETNSGIIVLAEGRLMNLGCATGHPSFVMSCSFTNQVIAQLELWNERTSGKYEKKVYVLPKHLDEKVAALHLGKLGARLTKLSKDQADYISVPVEGPYKPAHYRY

SEQ ID NO: 13925 - protein, 485 aa, Vinca minor
MALLVEKTSSGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYKKSGAIPDPNSTDNPEFQIVLTIIKDGLKSDPTKYTRMKDRLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSDADIFVTTTGNKDIIMVDHMKKIKNNAIVCNIGHFDNEIDMLGLETYPGVKRITIKPQTDRWVFPETNTGIIVLAEGRLMNLGCATGHPSFVMSCSFTNQVIAQLELWNERTSGKYKKEVYVLPKHLDEKVASLHLGKLGARLTKLSKDQADYISVPVEGPYKPAHYRY

SEQ ID NO: 13926 - protein, 485 aa, Leymus cinereus x Leymus triticoides
MALSVEKTSSGREYKVKDLSQADFGRLELELAEVEMPGLMACRTEFGPSQPFKGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDANKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWNEKATGKYEKKVYVLPKHLDEKVAALHLGKLGAKLTKLTKSQSDYISIPVEGPYKPAAYRY

SEQ ID NO: 13927 - protein, 485 aa, Medicago truncatula
MALLVETTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCSERALDWGTGGGPDLIVDDGGDVTLLIHEGVKAEEVFEKTGQLPDPSSTDNAEMQIVLTIIRDGLKTDPKRYQKMKTRIVGVSEETTTGVKRLYQMQATGTLLFPAINVNDSVTKSKFDNLYGCRHSLPDGLMRATDVMIAGKVAVVCGYGDVGKGCAAALKQGGARVIVTEIDPICALQALMEGLQVLTLEDVISEADIFVTTTGNKDIIMVSDMKKMKNNAIVCNIGHFDNEIDMHGLETYPGVKRITIKPQTDRWVFPETKSGIIVLAEGRLMNLGCATGHPSFVMSCSFTNQVIAQIELWKEKTSGKYEKKVYVLPKHLDEKVAALHLGQLGARLTKLSKDQADYISVPVEGPYKPAHYRY

SEQ ID NO: 13928 - protein, 485 aa, Panicum virgatum
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGGAGGPDLIVDDGGDATLLIHEGVKAEEEYEKSGKIPDPDSTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWKERSSGKYEKKVYVLPKHLDEKVAALHLGKLGAKLTKLTKSQADYISVPIEGPYKPAHYRY

SEQ ID NO: 13929 - protein, 485 aa, Theobroma cacao
MSLLVEKTSSGREYKVKDMSQADFGRLEIELAEVEMPGLMACRTEFGPSQPFKGAKITGSLHMTIQTAVLIETLTALGAEVRWCSCNIFSTQDHAASAIARDSAAVFAWKGETLQEYWWCTERALDWGPTGGPDLIVDDGGDATLLIHEGVKAEEVYEKTGQLPDPASTDNAEFQIVLTIIRDGLKTDRKKYTRMKNRLVGVSEETTTGVKRLYQMQANGSLLFPAINVNDSVTKSKFDNLYGCRHSLPDGLMRATDVMIAGKVAVVCGYGDVGKGCAAALKQAGARVIVTEIDPICALQALMEGLQVLTLEDVVCEADIFVTTTGNKDIIMVDHMRKMKNNAIVCNIGHFDNEIDMCGLENYPGVKRITIKPQTDRWVFPDTNSGIIVLAEGRLMNLGCATGHPSFVMSCSFTNQVIAQLELWNEKATGKYEKKVYVLPKHLDEKVAALHLPKLGAKLTKLSKEQADYISVPVEGPYKPAHYRY

SEQ ID NO: 13930 - protein, 485 aa, Triphysaria pusilla
MALLVEKTTSGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKTGKVPDPTSTDNVEFQFVLTIIRDGLKTDPKRYTKMKERLVGVSEETTTGVKRLYQMQASGTLLFPAINVNDSVTKSKFDNLYGCRHSLPDGLMRASDIMIAGKVGVVCGYGDVGKGCAAALKQGGARVIVTEIDPICALQALMEGFQVLPLEDVVSEADIFVTTTGNKDIIMVDDMRKMKNNAIVCNIGHFDNEIDMLGLETFPGVKRITIKPQTDRFVFPDTKSGVIILAEGRLMNLGCATGHPSFVMSCSFTNQVIAQLELWNERKSGKYEKKVYVLPKHLDEKVAALHLSKLGAKLTKLSKDQADYISVPVEGPYKPPHYRY

SEQ ID NO: 13931 - protein, 485 aa, Lactuca sativa
MALTVEKTSTGREYKVKDMSLADFGRLELELAEVEMPGLMSCRTEFGPSQPFKGARITGSLHMTIQTGVLIETLTALGAEVRWCSCNIFSTQDHAASAIARDSAAVFAWKGETLQEYWWCTERALDWGPGGGPDLIVDDGGDATLLIHEGVKAEEEFAKTGKLPDPTSTDNAEFQIVLSIIKEGLQSDPKKYHKMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIIVTTTGNKDIIMVDHMKKMKNNAIVCNIGHFDNEIDMLGLETYPGVKRVTIKPQTDRWVFPDTKTGVIILAEGRLMNLGCATGHPSFVMSCSFTNQVIAQLELWKEKGSGKYKKEVYVLPKHLDEKVAALHLGKLGAKLTKLSKDQADYINVPVEGPYKPVTYRY

SEQ ID NO: 13932 - protein, 391 aa, Euphorbia peplus
MALLVEKTTSGREYKVKDMSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYAKTGELPDPSSTDNVEFQLVLTIIRDGLKTDPQRYQKMKQRLVGVSEETTTGVKRLYQMQANGTLLFPAINVNDSVTKSKFDNLYGCRHSLPDGLMRATDVMIAGKVSVVAGYGDVGKGCAAALKQAGSRVIVTEIDPICALQATMEGYQVLTLEDVVSEADIFVTTTGNKDIIMVSHMRKMKNNAIVCNIGHFDNEIDMLGLETFPGVKRITIKPQTDRWVFPRYQLWCHHFG

SEQ ID NO: 13933 - protein, 280 aa, Ocimum basilicum
MALQVEKTTSGREYKVKDMSQADFGRLEIELAEVEMPGLISCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKSGKLPDPSSTDNAEFQIVLTLIRDGLKADPTKYRKMKERLVGVSEETTTGVKRLYQMQANGTLLFPAINVNDSVTKSKFDNLYGCRHSLPDGLMRATDVMIAGKVGVVCGYGDVGKGCAAA

SEQ ID NO: 13934 - protein, 251 aa, Cichorium intybus
MALVVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFAKTGKLPDPTSTDNAEFQIVLSIIKEGLAVDPKKYHKMKERLVGVSEKPPPVLRGCTRCKPMVLCFSLPLTSMTPSPRASSTTCTDAATHSPTV

SEQ ID NO: 13935 - protein, 242 aa, Cichorium intybus
MPTLTPRRTNESHRRHDCRKGRSSLRLRRRRKGLCRGHETSRSSRHSHRNRPNLRPPSSNGRSPSPNPRRRPLRSRHLRHHHRHKDIIMVDHMKKMKNNAIVCNIGHFDNEIDMLGLETYPGVKRITIKPQTDRWVFPDTKSGVIILAEGRLMNLGCATGHPSFVMSCSFTNQVIAQLELWKEKGSGKYKKEVYVLPKHLDEKVAALHLGKLGAKLTKLSKDQADYINVAVEGPYKPVNYRY

SEQ ID NO: 13936 - protein, 479 aa, Arnica chamissonis
KTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPDGGPDLIVDDGGDATLLIHEGVKAEEEFAKTGKLPDPTSTDNAEFQIVLSIIKEGLQSDPKKYHKMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETSPGVKRITIKPQTDRWVFPETNSGIIVLAEGRLMNLGCATGHPSFVMSCSFTNQVIAQLELWKEKSTGKYKKEVYVLPKHLDEKVAALHLGKLGAKLTKLSQDQADYISVPVEGPYKPAHYRY

SEQ ID NO: 13937 - protein, 485 aa, Cedrus atlantica
MALLAEKTVSGREYKVKDMSQADFGRLEIELAEVEMPGLMACRVEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEAEFAKTGKVPDPASTTNVEFQIVLELIKESLKVDPLKYHRMKDRLVGVSEETTTGVKRLYQMQNAGSLLFPAINVNDSVTKSKFDNLYGCRHSLPDGLMRATDVMIAGKVAVVCGYGDVGKGCAAAMKVAGARVIVTEIDPICALQALMEGLPVLTLEDVVSTADIFVTTTGNKDIIMLDHMRKMKNNAIVCNIGHFDNEIDMQGLETFPGVKKITIKPQTDRWVFPDTKSGIIVLAEGRLMNLGCATGHPSFVMSCSFTNQVIAQLELWNERKSGKYEKKVYVLPKHLDEKVAALHLPKLGAKLTKLTPDQAEYINVPVEGPYKPAQYRY

SEQ ID NO: 13938 - protein, 485 aa, Plantago ovata
MSLSVEKTTSGREYKVKDMSQADFGRLEIELAEVEMPGLMSSRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEEEFEKSGKLPDPTSTDNAEFQIVLSLIKDGLKTDPKRYTKMKERLVGVSEETTTGVKRLYQMQANGTLLFPAINVNDSVTKSKFDNLYGCRHSLPDGLMRATDVMIAGKVGVVCGYGDVGKGCAMSLKQAGARVIVTEIDPICALQALMEGFQVLTLEDVVSEADIFVTTTGNKDIIMLDHMRKMKNNAIVCNIGHFDNEIDMLGLETFPGVQRITIKPQTDRWVFPDTKSGVIILAEGRLMNLGCATGHPSFVMSCSFTNQVIAQLELWNERKTGKYEKKVYVLPKHLDEKVAALHLGKLGAKLTKLSKDQADYISVPVEGPYKPVHYRY

SEQ ID NO: 13939 - protein, 485 aa, Silene vulgaris
MALLVEKTTTGREYKVKDMSQADFGRLELELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKNGTIPDPTSTDNVEFQLVLGLIRESLKVDPKRYHKMKERLVGVSEETTTGVKRLYQMQANGTLLFPAINVNDSVTKSKFDNLYGCRHSLPDGLMRATDVMIAGKVGVVCGYGDVGKGCALALKAGGARVIVTEIDPICALQALMEGFQVLTLEDVVSEADIFVTTTGNKDIIMVDHMRKMKNNAIVCNIGHFDNEIDMQGLETFPGVKRITIKPQTDRFVFPDTNSGVIILAEGRLMNLGCATGHPSFVMSCSFTNQVIAQLELWNERSSGKYKKEVYVLPKHLDEKVAALHLGKLGAKLTKLTKEQADYISIPVEGPYKPAHYRY

SEQ ID NO: 13940 - protein, 485 aa, Tabernaemontana elegans
MALLVEKTSSGREYKVKDMSQADFGRLEIELAEVEMPGLMSCRAEFGPSQPFKGAKITGSLHMTIQTAVLIETLTALGAEVRWCSCNIFSTQDHAAAAIARDSAAVFAWKGETLQEYWWCTERALDWGADGGPDLIVDDGGDATLLIHEGVKAEEEYKKCGTLPDPNSTDNAEFQIVLTIIRDGLKADPTKYTRMKERLVGVSEETTTGVKRLYQMQANGTLLFSAINVNDSVTKSKFDNLYGCRHSLPDGLMRATDVMIAGKVAVVCGYGDVGKGCAAALKQAGARVIVTEIDPICALQALMEGLQVLTLEDVVSTADIFVTTTGNKDIIMVDHMKKMKNNAIVCNIGHFDNEIDMLGLETYPGVKRVTIKPQTDRWVFPETNSGIIVLAEGRLMNLGCATGHPSFVMSCSFTNQVIAQLELWNERTSGKYEKKVYVLPKHLDEKVAALHLGKLGAKLTKLTKEQADYISVPVEGPYKPPHYRY

SEQ ID NO: 13941 - protein, 485 aa, Fragaria vesca
MALSVEKHSSGREYKVKDMSQADFGRLEIELAEVEMPGLMASRVEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEEIFEKTGQLPDPTSTDNAEFQIVLSIIKEGLKTDPKRYRKMKDRIVGVSEETTTGVKRLYQMQNSGSLLFPAINVNDSVTKSKFDNLYGCRHSLPDGLMRATDVMIAGKVSVVCGYGDVGKGCAAALKQAGSRVIVTEIDPICALQALMEGLQVLPIEDVVSDADIFVTTTGNKDIIMLEHMRKMKNNAIVCNIGHFDNEIDMHGLETFPGVQRITIKPQTDRWVFPDTKTGIIVLAEGRLMNLGCATGHPSFVMSCSFTNQVIAQLELWNERKSGKYEKKVYVLPKHLDEKVAALHLGKLGAKLTKLSKEQADYISVPIEGPYKPAHYRY

SEQ ID NO: 13942 - protein, 481 aa, Solanum tuberosum
VEKTTSGREYKVKDMSQADFGRLEIELAEVEMPGLMACRTEFGPSQPFKGAKITGSLHMTIQTAVLIETLTALGAEVRWCSCNIFSTQDHAAAATARDSAAVFAWKGETLQEYWWCTERALDWGPGGGPDLIVDDGGDATLLIHEGVKAEEEYAKTGKFPDPNSTDNVEFQLVLTIIKDGLKSDPLKYTKMKERLVGVSEETTTGVKRLYQMQANGTLLFPAINVNDSVTKSKFDNLYGCRHSLPDGLMRATDVMIAGKVALIAGYGDVGKGCAAAMKQAGARVIVTEIDPICALQATMEGLQVLPLEDVVSEIDIFVTTTGNKDIIMVDHMRKMKNNAIVCNIGHFDNEIDMLGLETYPGVKRITIKPQTDRWVFPDTKSGIIVLAEGRLMNLGCATGHPSFVMSCSFTNQVIAQLELWKEKASGKYEKKVYVLPKHLDEKVAALHLGQLGVKLTKLSKDQADYISVPVEGPYKPAHYRY

SEQ ID NO: 13943 - protein, 485 aa, Arachis hypogaea
MSLSVEKTTSGREYKVKDLSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPSGGPDLIVDDGGDATLLIHEGVKAEELYEKTGQLPDPASTDNAEFQIVLTIIRDGLKTDPQRYRRMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETNTGIIVLAEGRLMNLGCATGHPSFVMSCSFTNQVIAQLELWTEKSSGKYEKKVYVLPKHLDEKVAALHLGKLGAKLTKLSQSQADYISVPVEGPYKPPHYRY

SEQ ID NO: 13944 - protein, 485 aa, Lactuca sativa
MALVVEKTSSGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERSLDWGPGGGPDLIVDDGGDATMLIHEGVKAEEEFAKTGKLPDPTSTDNAEFQIVLSIIKEGLQINPTKYHKMKERLVGVSEETTTGVKRLYQMQANGSLLFPAINVNDSVTKSKFDNLYGCRHSLPDGLMRATDVMIAGKVAVVCGYGDVGKGCASAMKQAGARVIVTEIDPICALQALMEGLQVLTLEDVLPHADIFVTTTGNKDIIMVDDMKKMKNNAIVCNIGHFDNEIDMLGLETYPGVKRITIKPQTDRWVFPETKSGIIVLAEGRLMNLGCATGHPSFVMSCSFTNQVIAQLELWNEKGSGKYKKQVYVLPKHLDEKVAALHLEKLGAKLTKLSEDQADYISVPVNGPYKPAHYRY

SEQ ID NO: 13945 - protein, 485 aa, Glycine max
MALLVEKTTSGREYKVKDLSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGELPDPNSTDNAEFQIVLTIIRDGLKTDPTRYRKMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMKKMKNNAIVCNIGHFDNEIDMLGLENYPGVKRITIKPQTDRWVFPETNVGIIVLAEGRLMNLGCATGHPSFVMSCSFTNQVIAQLELWKEKSTGKYEKKVYVLPKHLDEKVAALHLGKLGAKLTKLSPAQADYISVPVEGPYKPAHYRY

SEQ ID NO: 13946 - protein, 485 aa, Taraxacum officinale
MALTVEKTSTGREYKVKDMSLADFGRLELDLAEVEMPGLMSCRTEFGPSQPFKGARITGSLHMTIQTAVLIETLTALGAEVRWCSCNIFSTQDHAAAAIARDSAAVFAWKGETLEEYWWCTERALDWGPGGGPDLIVDDGGDATLLIHEGVKAEEEFAKTGKLPDPTSTDNAEFQIVLSIIKEGLSTDPKKYHKMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLEDVVSEADIFVTTTGNKDIIMVSDMKKMKNNAIVCNIGHFDNEIDMLGLETYPGVKRITIKPQTDRWVFPETNTGIIVLAEGRLMNLGCATGHPSFVMSCSFTNQVIAQLELWKERTSGKYQKEVYVLPKHLDEKVAALHLGKLGARLTKLSKDQADYIHVPVEGPYKPANYRY

SEQ ID NO: 13947 - protein, 335 aa, Flaveria ramosissima
MSLTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKSGKLPDPTSTDNAEFQIVLSIIKEGLQSDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQVGARVIVTEIDPICALQATMEGLQVLTLDDVVQRPISSLPPLATRTSSWFPT

SEQ ID NO: 13948 - protein, 280 aa, Ocimum basilicum
MALQVEKTTSGREYKVKDMSQADFGRLEIELAEVEMPGLISCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKTGKLPDPSSTDNAEFQIVLTLIRDGLKANPTKYRKMKERLVGVSEETTTGVKRLYQMQANGTLLFPAINVNDSVTKSKFDNLYGCRHSLPDGLMRATDVMIAGKVGVVCGYGDVGKGCAAA

SEQ ID NO: 13949 - protein, 485 aa, Amsonia hubrichtii
MALSVDKTSSGREYKVKDMSQADFGRLEIELAEVEMPGLMACRAEFGPSQPLKGACITGSLHMTIQTAVLIETLTALGATVRWCSCNIFSTQDHAAAAIARDSAAVFAWKGETLQEYWWCTERALDWGSEGGPDLIVDDGGDATLLIHEGVKAEEEYEKTGKLPDPSSTDNAEFQIVLGIIRDGLKADPKKYRKMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGIQVLTLEDVVSEADIFVTTTGNKDIIMVDHMRKMKNNAIVCNIGHFDNEIDMLGLETYPGVKRITIKPQTDRWVFPETGTGIIVLAEGRLMNLGCATGHPSFVMSCSFTNQLIAQLELWKEKASGKYEKKVYVLPKHLDEKVAALHLGKLGAKLTKLTPDQAAYISVPAEGPYKPPHYRY

SEQ ID NO: 13950 - protein, 485 aa, Arnica chamissonis
MSLTVEKTSTGREYKVKDMSLADFGRLEHELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPTSTDNAEFQIVLSIIKEGLQIDPKKYHKMKDRLVGVSEETTTGVKRLYQMQANGTLLFPAINVNDSVTKSKFDNLYGCRHSLPDGLMRATDIMIAGKVAVVCGYGDVGKGCAAAMKQAGARVIVTEIDPICALQALMEGLQVLTLEDALSEADIFVTTTGNKDIVMVDHMKRMKNNAIVCNIGHFDNEIDMLGLETYPGVKRITIKPQTDRWVFPETNSGIIVLAEGRLMNLGCATGHPSFVMSCSFTNQVIAQLELWKERSSGKYKKEVYVLPKHLDEKVAALHLGKLGAKLTKLSQDQADYISVPVEGPYKPAQYRY

SEQ ID NO: 13951 - protein, 485 aa, Chelidonium majus
MALVVEKTSSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGAGGGPDLIVDDGGDATLLIHEGVKAEEEFEKSGKIPDPTSTDNVEFQIVLSIIKDGLTTDPKRYHKMKERLVGVSEETTTGVKRLYQMETSGTLLFPAINVNDSVTKSKFDNLYGCRHSLPDGLMRATDVMIAGKVAFVAGYGDVGKGCAAALKQAGARVIVSEIDPICALQATMEGLQVLPLDDVVGEVDIFVTTTGNKDIIMVSDMKKMKNNAIVCNIGHFDNEIDMQGLETYPGVKRITIKPQTDRWVFPETNTGIIVLAEGRLMNLGCATGHPSFVMSCSFTNQVIAQLELWNEKASGKYEKKVYVLPKHLDEKVAALHLGKLGAKLTVLSKDQADYISVPVEGPYKPAHYRY

SEQ ID NO: 13952 - protein, 485 aa, Humulus lupulus
MSLSVQKTPAGREYKVKDLSQADFRRLEIELPEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIYEKNGQLPDPTSTDNVEFQLVLSIIKEGLKTDPKRYHKMKDRLVGVSEETTTGVKRLYQMQANGSLLFPAINVNDSVTKSKFDNLYGCRHSLPDGLMRATDVMIAGKVAVVCGYGDVGKGCAAALKQAGARVIVTEIDPICALQALMEGLQILTLEDVVSEADIFVTTTGNKDIIMVDHMKKMKNNAIVCNIGHFDNEIDMLGLETYPGVKRITIKPQTDRWVFPETNVGIIVLAEGRLMNLGCATGHPSFVMSCSFTNQVIAQLELWNEKSSGKYKKEVYVLPKHLDEKVAALHLGKLGAKLTKLSKDQADYISVPVEGPYKPIHYRY

SEQ ID NO: 13953 - protein, 485 aa, Pinus pinaster
MALYTEKTVSGREYKVKDMSQADFGRLEIELAEVEMPGLMACRVEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEEEFAKTGKVPDPSSTTNVEFQIVLELIKESLKVDPLRYHRMKDRIVGVSEETTTGVKRLYQMQNAGSLLFPAINVNDSVTKSKFDNLYGCRHSLPDGLMRATDVMIAGKVAVVCGFGDVGKGCAAALKVAGARVIVTEIDPICALQALMEGLPVLTLEDVVSTADIFVTTTGNKDIIMVDHMRKMKNNAIVCNIGHFDNEIDMQGLETFPGVKKITIKPQTDRWVFPDTNSGIIVLAEGRLMNLGCATGHPSFVMSCSFTNQVIAQLELWNEKKSGKYEKKVYVLPKHLDEKVAALHLPKLGAKLTKLSPDQAEYINVPIEGPYKPAHYRY

SEQ ID NO: 13954 - protein, 485 aa, Lippia dulcis
MALIVEKTSSGREYKVKDMSLADFGRLEIELAEVEMPGLMSCRTEFGPSQPFKGARITGSLHMTIQTAVLIETLTALGAEVRWCSCNIFSTQDHAAATIARDSAAVFAWKGETLQEYWWCTERSLDWGPDGGPDLIVDDGGDVTLLIHEGVKAEEEYEKSGKLPDPTSTDNAEFQIVLTIIKDGLKADPKKYTRMKERLVGVSEETTTGVKRLYQMQANGSLLFPAINVNDSVTKSKFDNLYGCRHSLPDGLMRATDVMIAGKVGVVCGYGDVGKGCASALKQAGARVIVTEIDPICALQALMEGYQVLTLEDVLSVADIFVTTTGNKDIIMVDHMRKMKNNAIVCNIGHFDNEIDMHGLETFPGVKRTTIKPQTDRFVFPDTNSGVIVLAEGRLMNLGCATGHPSFVMSCSFTNQVIAQLELWNERKSGKYEKKVYVLPKHLDEKVAALHLGKLGAKLTKLSKDQADYISVPIEGPYKPPHYRY

SEQ ID NO: 13955 - protein, 485 aa, Valeriana officinalis
MDLVVEKTTSGQEYKVKDMSQADFGRLEIELAEVEMPGLMSCRTEFGPSQPFKGAQITGSLHMTIQTAVLIETLTALGASVRWCSCNIFSTQDHAAAAIARDSAAVFAWKGETLQEYWWCTERALDWGPGSGPDLIVDDGGDATLLIHEGVKAEEEYEKTGKIPDPTSTDNPEFQIVLSIIKDGLKTDPKKYHKMKERLVGVSEETTTGVKRLYQMQANGTLLFPAINVNDSVTKSKFDNLYGCRHSLPDGLMRATDVMIAGKVAVVCGYGDVGKGCASAMKQAGARVIVTEIDPICALQALMEGIPVKTLEDVVAEADIFVTTTGNKDIIMVDDMRKMKNNAIVCNIGHFDNEIDMLGLETYPGVKRITIKPQTDRWVFPETGRGILVLAEGRLMNLGCATGHPSFVMSCSFTNQVIAQLELWNERKSGKYEKKVYVLPKHLDEKVAALHLGKLGAKLTKLSPEQAAYISIPVEGPYKPPHYRY

SEQ ID NO: 13956 - protein, 485 aa, Aquilegia formosa
MALIVEKTSSGREYKVKDMSQADFGRLELDLAEVEMPGLISCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKSGKLPDPSSTDNAEFQIVLTIIRDGLKTDPKKYQKMKQRLVGVSEETTTGVKRLYQMQANGTLLFPAINVNDSVTKSKFDNLYGCRHSLPDGLMRATDVMIAGKVAFVAGYGDVGKGCAAALKQGGARVIVSEIDPICALQALMEGFQVLPLEDVVSYVDIFVTTTGNKDIIMVDDMRKMKNNAIVCNIGHFDNEIDMQGLETYPGVKRITIKPQTDRWVFPDTKSGIIILAEGRLMNLGCATGHPSFVMSCSFTNQVIAQLELWNERNSGKYEKKVYVLPKHLDEKVAQLHLGKLGAKLTKLTHDQSEYISIPVEGPYKPAQYRY

SEQ ID NO: 13957 - protein, 485 aa, Triphysaria pusilla
MALLVEKTTSGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKSGTLPDPTSTDNAEFQLVLTIIRDGLKTDPKRYTKMKERLVGVSEETTTGVKRLYQMQANGTLLFPAINVNDSVTKSKFDNLYGCRHSLPDGLMRATDVMIAGKVGVVCGYGDVGKGCAAALKQGGARVIVTEIDPICALQALMEGFHVLPLEDVVSEADIFVTTTGNKDIIMVDHMRKMKNNAIVCNIGHFDNEIDMLGLETFPGVKRTTIKPQTDRWVFPDTKSGILVLAEGRLMNLGCATGHPSFVMSCSFTNQVIAQLELWNERKSGKYEKKVYVLPKHLDEKVAALHLAKLGAKLTKLSKEQADYISVAVEGPYKPAHYRY

SEQ ID NO: 13958 - protein, 485 aa, Citrus sinensis
MALSVEKSASGREFKVKDLSQADFGRLEIELAEVEMPGLMACRAEFGPSQPFKGAKITGSLHMTIQTAVLIETLTALGAEVRWCSCNIFSTQDHAAAAIARDSASVFAWKGETLQEYWWCTEKALDWGPGGGPDLIVDDGGDATLLIHEGVKAEEIYEKTGKLPDPASTDNAEFQIVLTIIRDGLKADPKKYHKMKERLVGVSEETTTGVKRLYQMQENGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSDADIFVTTTGNKDIIMVDHMKKMKNNAIVCNIGHFDNEIDMLGLETYPGVKRITIKPQTDRWVFPETNSGIIVLAEGRLMNLGCATGHPSFVMSCSFTNQVIAQLELWKEKSTGKYEKKVYVLPKHLDEKVAALHLGKLGAKLTRLTKEQADYISVSADGPYKPLHYRY

SEQ ID NO: 13959 - protein, 485 aa, Lotus japonicus
MALLVEKTTSGREYKVKDLSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEVFEKTGELPDPTSTDNPEFQIVLTIIRDGLKTDSHRYRKMKERLVGVSEETTTGVKRLYQMQANGTLLFPAINVNDSVTKSKFDNLYGCRHSLPDGLMRATDIMIAGKVAVVAGYGDVGKGCAAALKQAGARVIVTEIDPICALQALMEGLQVLTLEDVVSEADIFVTTTGNKDIIMVDHMRKMKNNAIVCNIGHFDNEIDMLGLESYPGVKRITIKPQTDRFVFPETNTGIIVLAEGRLMNLGCATGHPSFVMSCSFTNQVIAQLELWNERNSGKYKKEVYVLPKHLDEKVAALHLGKLGARLTKLSKDQADYISVPVEGPYKPLHYRY

SEQ ID NO: 13960 - protein, 485 aa, Triphysaria pusilla
MALLVEKTTSGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKSGKVPDPTSTDNVEFQFVLTIIRDGLKTDPKRYTKMKERLVGVSEETTTGVKRLYQMQESGTLLFPAINVNDSVTKSKFDNLYGCRHSLPDGLMRATDVMIAGKVGVVCGYGDVGKGCAAALKQGGARVIVTEIDPICALQALMEGFQVLPLEDCVSEADIFVTTTGNKDIIMVNDMRKMKNNAIVCNIGHFDNEIDMLGLETFPGVKRITIKPQTDRFVFPDTKSGVIILAEGRLMNLGCATGHPSFVMSCSFTNQVIAQLELWNERKSGKYENKVYVLPKHLDEKVAALHLSKLGAKLTKLSKDQADYISVPVEGPYKPAHYRY

SEQ ID NO: 13961 - protein, 488 aa, Aquilegia formosa
MATTDLVVEKTSSGREYKVKDMSQADFGRLELELAEVEMPGLMSCRTEFGPSQPFKGARITGSLHMTIQTAVLIETLTSLGAEVRWCSCNIFSTQDHAAAAIARDSAAVFAWKGETLQEYWWCTERALDWGIGGGPDLIVDDGGDATLLIHEGVKAEEEFQKTGKLPDPASTDNVEFQIVLGIIKDGLSVDPKKYHKMKERLVGVSEETTTGVKRLYQMQLNGTLLFPAINVNDSVTKSKFDNLYGCRHSLPDGLMRATDVMIAGKVAVVCGYGDVGKGCAAALKQGGARVIVTEIDPICALQALMEGFQVLTLEDAVSDADIFVTTTGNKDIIMVDHMKKMKNNAIVCNIGHFDNEIDMHGLETLPGVKRITIKPQTDRWVFPETNTGIIVLAEGRLMNLGCATGHPSFVMSCSFTNQVIAQLELWKERATGKYEKKVYVLPKHLDEKVAALHLGKLGAKLTKLTPEQADYISIPVEGPYKPPHYRY

SEQ ID NO: 13962 - protein, 242 aa, Eucalyptus grandis
MALSVEKTTGGREYKVKDMSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGKLPDPASTDNAEFQLVLTIIRDGLKTDPQRYHKMKDRLVGVSEETTTGVKRLYQMQANGTLLFPAINVNDSVTKSKVTVLV

SEQ ID NO: 13963 - protein, 414 aa, Avena sativa
MALSVEKTSSGREYKVKDLSQADFGRLELDLAEVEMPGLMACRAEFGPSQPFKGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEFEKSGKVPDPESTDNPEFKIVLTIIRDGLKTDVRRYRKMKERLVGVSEETTTGVKRLYQMQESGALLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGRQAHHHQAPDRPLGLPRDQDRHHCPCRGSPDEPWVRHWPPQLRHVLLVH

SEQ ID NO: 13964 - protein, 249 aa, Avena sativa
MALSVEKTSSGREYKVKDLSQADFGRLELDLAEVEMPGLMACRAEFGPSQPFKGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEFEKSGKVPDPESTDNPEFKIVLTIIRDGLKTDVRRYRKMKGEARGCLRGDHHRRQEALPDAGVRRAPLPRHQRQRLRHQEQVRQPLRLPPLPP

SEQ ID NO: 13965 - protein, 405 aa, Mesembryanthemum crystallinum
MALAVEKTSSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGAGGGPDLIVDDGGDATLLIHEGVKAEEEYEKNGTIPDPTSTDNPEFQLVLGLIRDSLKVDPKRYHKMKTRLVGVSEETTTGVKRLYQMQATGTLLFPAINVNDSVTKSKFDNLYGCRHSLPDGLMRATDVMIAGKVGVVCGYGDVGKGCALALKAAGARVIVTEIDPICALQALMEGFQILTLEDVVSEADIFVTTTGNKDIIMVDHMRKMKNNAIVCNIGHFDNEIDMLGLENYPGVKRITIKPQTDRFVFPETNTGIIVLAEGRLMKLGLCHRSP

SEQ ID NO: 13966 - protein, 485 aa, Avena sativa
MALSVEKTSSGREYKVKDLSQADFGRLELDLAEVEMPGLMACRAEFGPSQPFKGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEFEKSGKVPDPESTDNPEFKIVLTIIRDGLKTDVRRYRKMKERLVGVSEETTTGVKRLYQMQESGALLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNERKSGKYEKKVYVLPKHLDEKVAALHLGKLGAKLTKLTKSQSEYISIPVEGPYKPAAYRY

SEQ ID NO: 13967 - protein, 485 aa, Phalaenopsis aphrodite
MALLVEKTTSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLQEYWWCTERCLEWGAGGGPDLIVDDGGDATLLIHEGVKAEEEYEKNGKIPDPASTDNAEFQIVLGLIRDSLSVDPKKYRRMKERLVGVSEETTTGVKRLYQMQYSGTLLFPAINVNDSVTKSKFDNLYGCRHSLPDGLMRATDVMIAGKVAVVCGYGDVGKGCAAALKTAGARVIVTEIDPICALQALMEGLPVLRLEDVVSEADIFVTTTGNKDIIMVDHMRKMKNNAIVCNIGHFDNEIDMLGLESFPGVKRITIKPQTDRWVFPDTNSGILVLAEGRLMNLGCATGHPSFVMSCSFTNQVIAQLELWKEKASGKYEKKVYVLPKHLDEKVAALHLGKLGAKLTKLTPSQADYISVPVEGPYKPAHYRY

SEQ ID NO: 13968 - protein, 485 aa, Trigonella foenum-graecum
MALLVETTTSGREYKVKDMSQADFGRLEIELAEVEMPGLMSCRTEFGSSQPFKGARITGSLHMTIQTAVLIETLTALGAEVRWCSCNIFSTQDHAAAAIARDSAAVFAWKGETLQEYWWCSERALDWGTGGGPDLIVDDGGDVTLLIHEGVKAEEAFEKNGQLPDPSSTDNAEMQIVLTIIRDGLKTDPKRYQKMKDRIVGVSEETTTGVKRLYQMQATGALLFPAINVNDSVTKSKFDNLYGCRHSLPDGLMRATDVMIAGKVAVVCGYGDVGKGCAAALKQGGARVIVTEIDPICALQALMEGLQVLTLEDVISEADIFVTTTGNKDIIMVSDMRKMKNNAIVCNIGHFDNEIDMHGLETYPGVKRITIKPQTDRWVFPENNSGIIILAEGRLMNLGCATGHPSFVMSCSFTNQVIAQIELWKEKTSGKYEKKVYVLPKHLDEKVAALHLGQLGARLTKLSKDQADYISVPVEGPYKPAHYRY

SEQ ID NO: 13969 - protein, 485 aa, Citrullus lanatus
MSLLVDKTSSGREYKVKDMAQADFGRLEIDLAEVEMPGLMACRTEYGPSQPFKGARITGSLHMTIQTAVLIETLTALGAEVRWCSCNIFSTQDHAAAAIARDSAAVFAWKGETLQEYWWCTERSLDWGPDGGPDLIVDDGGDATLLIHEGVKAEEIYEKTGTLPDPSTTTNSEFQIVLTIVRDGLKTDPKRYHKMKERLVGVSEETTTGVKRLYQMQANGTLLFPAINVNDSVTKSKFDNLYGCRHSLPDGLMRATDVMIAGKVAVVCGYGDVGKGCAFALKQGGARVIVTEIDPICALQALMEGFQVLTLNDIVSEADIFVTTTGNKDIIMVNDMRKMKNNAIVCNIGHFDNEIDMLGLETFPGVKRITIKPQTDRWVFPDTNSGIIVLAEGRLMNLGCATGHPSFVMSCSFTNQVIAQLELWNERKSGKYEKKVYVLPKHLDEKVAALHLGKLGAKLTKLSKDQADYISVPIEGPYKPAHYRY

SEQ ID NO: 13970 - protein, 484 aa, Festuca arundinacea
ALSVEKTSSGREYKVKDLSQADFGRLELDLAEVEMPGLMACRAEFGPAQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDVRRYRKMKERLVGVSEETTTGVKRLYQMQESGALLFPAINVNDSVTKSKFDNLYGCRHSLPDGLMRATDVMIAGKVAVVCGYGDVGKGCAAALKQAGARVIVTEIDPICALQALMEGIQILTLEDVVSEADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNERKSGKYEKKVYVLPKHLDEKVAALHLGKLGAKLTKLTKSQSDYISIPVEGPYKPAAYRY

SEQ ID NO: 13971 - protein, 485 aa, Triticum aestivum
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKASGKYEKKVYVLPKHLDEKVAALHLGKLGARLTKLTKAQSEYISIPVEGPYKPAAYRY

SEQ ID NO: 13972 - protein, 485 aa, Hordeum vulgare
MALSVEKTSSGREYKVKDLSQADFGRLELELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFEKSGKVPDPESTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVEGPYKPSAYRY

SEQ ID NO: 13973 - protein, 485 aa, Vigna unguiculata
MSLLVEKTTSGREYKVKDLSQADFGRLELDLAEVEMPGLMACRAEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGELPDPASTDNAEFQIVLTIIRDGLKTDPSRYRKMKERLVGVSEETTTGVKRLYQMQANGTLLFPAINVNDSVTKSKFDNLYGCRHSLPDGLMRATDVMIAGKVAVVAGYGDVGKGCAAALKQAGARVIVTEIDPICALQALMEGLQVLTLEDVVSEADIFVTTTGNKDIIMVDHMKKMKNNAIVCNIGHFDNEIDMLGLENYPGVKRITIKPQTDRWVFPETNTGIIVLAEGRLMNLGCATGHPSFVMSCSFTNQVIAQLELWKEKNSGKYEKKVYVLPKHLDEKVAALHLGKLGAKLTKLSKDQADYISVPVEGPYKPAHYRY

SEQ ID NO: 13974 - protein, 485 aa, Picea glauca
MALLAEKTVSGREYKVKDMSQADFGRLEIELAEVEMPGLMACRAEFGPAQPFKGARITGSLHMTIQTAVLIETLAALGAEVRWCSCNIFSTQDHAAAAIARDSAAVFAWKGETLQEYWWCTERALDWGPGGGPDLIVDDGGDATLLIHEGVKAEEEFAKTGKVPDPESTTNLEFQMVLGLIKESMKVDPLRYHRMKERLVGVSEETTTGVKRLYQMQASGTLLFPAINVNDSVTKSKFDNLYGCRHSLPDGLMRATDVMIAGKVAVVCGYGDVGKGCAAALKVAGARVIVTEIDPICALQALMEGLPVLTLEDVVSTADIFVTTTGNKDIIMLDHMRKMKNNAIVCNIGHFDNEIDMQGLETFPGVKKITIKPQTDRWVFPDTNSGIIVLAEGRLMNLGCATGHPSFVMSCSFTNQVIAQLELWNERKSGKYEKKVYVLPKHLDEKVAALHLPKLGARLTKLSPDQAEYINVPVEGPYKPAHYRY

SEQ ID NO: 13975 - protein, 485 aa, Pinus pinaster
MALLAEKTVSGREFKVKDLSQADFGRLEIELAEVEMPGLMACRAEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKTGKVPDPASTTNLEFQMVLGLIKDSIKVDPLRYHKMKDRLVGVSEETTTGVKRLYQMQASGTLLFPAINVNDSVTKSKFDNLYGCRHSLPDGLMRATDVMIAGKVAVVCGYGDVGKGCAAALKVAGARVIVTEIDPICALQALMEGLPVLTIEDVVSTADIFVTTTGNKDIIMVDHMRKMKNNAIVCNIGHFDNEIDMQGLETFPGVKKITIKPQTDRWVFPDTNSGIIVLAEGRLMNLGCATGHPSFVMSCSFTNQVIAQLELWNEKKSGKYEKKVYVLPKHLDEKVAALHLPKLGAHLTKLSPEQAAYINVPVEGPYKPAHYRY

SEQ ID NO: 13976 - protein, 485 aa, Avena sativa
MALSVEKTSSGREYKVKDLSQADFGRLELDLAEVEMPGLMACRAEFGPSQPFKGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEFEKSGKIPDPESTDNPEFKIVLTIIRDGLKTDVRRYRKMKERLVGVSEETTTGVKRLYQMQESGALLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETKTGIIVLAEGRLMNLGCATGHPSFVMSCSFTNQVIAQLELWNERKSGKYEKKVYVLPKHLDEKVAALHLGKLGAKLTKLTKSQSEYISIPVEGPYKPAAYRY

SEQ ID NO: 13977 - protein, 485 aa, Citrus sinensis
MALSVEKSASGREFKVKDLSQADFGRLEIELAEVEMPGLMACRAEFGPSQPFKGAKITGSLHMTIQTAVLIETLTALGAEVRWCSCNIFSTQDHAAAAIARDSASVFAWKGETLQEYWWCTEKALDWGPGGGPDLIVDDGGDATLLIHEGVKAEEIYEKTGKLPDPASTDNAEFQIVLTIIRDGLKADPKKYHKMKERLVGVSEETTTGVKRLYQMQENGTLLFPAINVNDSVTKSKFDNLYGCRHSLPDGLMRATDVMIAGKVAVVCGYGDVGKGCAAALKQAGARVIVTEIDPICALQALMEGLQVLTLEDVLSDADIFVTTTGNKDIIMVDHMKKMKNNAIVCNIGHFDNEIDVLGLETYPGVKRITIKPQTDRWVFPETNSGIIVLAEGRLMNLGCATGHPSFVMSCSFTNQVIAQLELWKEKSTGKYEKKVYVLPKHLDEKVAALHLGKLGAKLTRLTKEQADYISVSADGPYKPLHYRY

SEQ ID NO: 13978 - protein, 485 aa, Phalaenopsis aphrodite
MALLVEKTTSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLQEYWWCTERCLEWGAGGGPDLIVDDGGDATLLIHEGVKAEEEYEKNGKIPDPASTDNAEFQIVLGLIRDSLSVDPKKYRRMKERLVGVSEETTTGVKRLYQMQYSGTLLFPAINVNDSVTKSKFDNLYGCRHSLPDGLMRATDVMIAGKVAVVCGYGDVGKGCAAALKTAGARVIVTEIDPICALQALMEGLPVLRLEDVVSEADIFVTTTGNKDIIMVDHMRKMKNNAIVCNIGHFDNEIDMLGLESFPGVKRITIKPQTDRWVFPDTNSGILVLAEGRLMNLGCATGHPSFVMSCSFTNQVIAQLELWKERASGKYEKKVYVLPKHLDEKVAALHLGKLGAKLTKLTPSQADYISVPVEGPYKPAHYRY

SEQ ID NO: 13979 - protein, 485 aa, Tabernaemontana elegans
MALSVDKTSSGREYKVKDMSQADFGRLEIELAEVEMPGLLACRAEFGPPQPLKGARITGSLHMTIQTAVLIETLTALGASVRWCSCNIFSTQDHAAAAIARDSAAVFAWKGETLQEYWWCTERALDWGSEGGPDLIVDDGGDATLLIHEGVKAEEEYEKTGKLPDPSSTDNAEFQIVLGIIRDGLKVDPKKYHKMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGIPVLTLEDAVSEADIFVTTTGNKDIIMVDHMRKMKNNAIVCNIGHFDNEIDMLGLETYPGVKRITIKPQTDRWVFPETGTGIIVLAEGRLMNLGCATGHPSFVMSCSFTNQVIAQLELWKEKTSGKYEKKVYVLPKHLDEKVAALHLGKLGAKLTNLTPEQAAYISVPVDGPYKPAHYRY

SEQ ID NO: 13980 - protein, 477 aa, Vinca minor
SSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEEEYKKSGAIPDPNSTDNAEFQIVLTIIKDGLKSDPSKYTKMKERLVGVSEETTTGVKRLYQMQANGTLLFPAINVNDSVTKSKFDNLYGCRHSLPDGLMRATDVMIAGKVALVAGYGDVGKGCAAALKQAGARVIVTEIDPICALQALMEGLQVLTLEDVVSDVDIFVTTTGNKDIIMVDHMKKMKNNAIVCNIGHFDNEIDMLGLETYPGVKRITIKPQTDRWVFPETKTGIIVLAEGRLMNLGCATGHPSFVMSCSFTNQVIAQLELWNERTSGKYEKKVYVLPKHLDEKVAALHLGKLGARLTKLSKDQADYISVPVEGPYKPAHYRY

SEQ ID NO: 13981 - protein, 485 aa, Antirrhinum majus
MALLVEKTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEDEYEKNGTIPDPTSTDNAEFQIVLTIIRDGLKADPKKYNKMKQRLVGVSEETTTGVKRLYQMEQNGTLLFPAINVNDSVTKSKFDNLYGCRHSLPDGLMRATDVMIAGKVGVVCGYGDVGKGCAAALKQGGARVIVTEIDPICALQALMEGFQVLPLEDVVSEADIFVTTTGNKDIIMVDDMRKMKNNAIVCNIGHFDNEIDMLGLETYPGVKRITIKPQTDRWVFPETNTGIIILAEGRLMNLGCATGHPSFVMSCSFTNQVIAQLELWKERTTGKYEKKVYVLPKHLDEKVAALHLGKLGAKLTKLSKDQADYISVPVEGPYKPAHYRY

SEQ ID NO: 13982 - protein, 485 aa, Amborella trichopoda
MALLVEKTVSGREYKVKDMSQADFGRLEIELAEVEMPGLMACRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKSGKLPDPASTTNPEFQIVLGIIKDGLKADPKKYHKMKDRLVGVSEETTTGVKRLYQMHANGTLLFSAINVNDSVTKSKFDNLYGCRHSLPDGLMRATDVMIAGKVAVVCGYGDVGKGCASALKQAGARVIVTEIDPICALQALMEGIPVLTLEDVVSEADIFVTATGNKDIIMVDHMRKMKNNAIVCNIGHFDNEIDMQGLETYPGVKRNTIKPQTDRWVFPETNSGIIVLAEGRLMNLGCATGHPSFVMSCSFTNQVIAQLELWKEKGTGKYQKQVYVLPKHLDEKVASLHLGKLGAHLTKLSPDQAEYINVPIEGPYKPPQYRY

SEQ ID NO: 13983 - protein, 485 aa, Citrus clementina
MALSVQKSASGREFKVKDLSQADFGRLEIELAEVEMPGLMACRAEFGPSQPFKGAKITGSLHMTIQTAVLIETLTALGAEVRWCSCNIFSTQDHAAAAIARDSASVFAWKGETLQEYWWCTEKALDWGPGGGPDLIVDDGGDATLLIHEGVKAEEIYEKTGKLPDPASTDNAEFQIVLTIIRDGLKADPKKYHKMKERLVGVSEETTTGVKRLYQMQENGTLLFPAINVNDSVTKSKFDNLYGCRHSLPDGLMRATDVMIAGKVAVVCGYGDVGKGCAAALKQAGARVIVTEIDPICALQALMEGLQVLTLEDVLSDADIFVTTTGNKDIIMVDHMKKMKNNAIVCNIGHFDNEIDVLGLETYPGVKRITIKPQTDRWVFPETNSGIIVLAEGRLMNLGCATGHPSFVMSCSFTNQVIAQLELWKEKSTGKYEKKVYVLPKHLDEKVAALHLGKLGAKLTRLTKEQADYISVSADGPYKPLHYRY

SEQ ID NO: 13984 - protein, 485 aa, Phalaenopsis aphrodite
MALLVEKTTSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLQEYWWCTERCLEWGAGGGPDLIVDDGGDATLLIHEGVKAEEEYEKNGKIPDPASTDNAEFQIVLGLIRDSLSVDPKKYRRMKERLVGVSEETTTGVKRLYQMQYSGTLLFPAINVNDSVTKSKFDNLYGCRHSLPDGLMRATDVMIAGKVAVVCGYGDVGKGCAAALKTAGARVIVTEIDPICALQALMEGLPVLRLEDVVSEADIFVTTTGNKDIIMVDHMRKMKNNAIVCNIGHFDNEIDMLGLESFPGVKRITIKPQTDRWVFPDSNSGILVLAEGRLMNLGCATGHPSFVMSCSFTNQVIAQLELWKERASGKYEKKVYVLPKHLDEKVAALHLGKLGAKLTKLTPSQADYISVPVEGPYKPAHYRY

SEQ ID NO: 13985 - protein, 485 aa, Plantago ovata
MSLSVEKTTSGREYKVRDMTQADFGRLEIELAEVEMPGLMSCRTEFGPSQPFKGARITGSLHMTIQTAVLIETLTALGAEVRWCSCNIFSTQDHAAAAIARDSAAVFAWKGENLQEYWWCTERALDWGPGGGPDLIVDDGGDATLLIHEGVKAEEEFAKNGTIPDPTSTDNAEFQIVLSIIKDGLTIDPKRFTKMKERLVGVSEETTTGVKRLYQMQANGTLLFPAINVNDSVTKSKFDNLYGCRHSLPDGLMRATDVMIAGKVGVVCGYGDVGKGCASALKQAGARVIVTEIDPICALQALMEGYQVLTLEDVVSDADIFVTTTGNKDIIMLEHMRKMKNNAIVCNIGHFDNEIDMHGLETYPGVKRTTIKPQTDRWVFPETNTGIIVLAEGRLMNLGCATGHPSFVMSCSFTNQVIAQLELWNERTSGKYKKEVYVLPKHLDEKVAALHLGKLGAKLTKLSKDQADYISVPVEGPYKPAHYRY

SEQ ID NO: 13986 - protein, 485 aa, Musa acuminata
MALLVEKTSTGREYKVKDLSQADFGRLEIELAEVEMPGLMACRAEFGPAKPFAGARISGSLHMTIQTAVLIETLTALGAEVRWCSCNIFSTQDHAAAAIARDSAAVFAWKGETLAEYWWCTERCLDWGPNGGPDLIVDKGGDATLLIHEGVKAEEEYEKTGKLPDPASTENAEFQIVLGIIRDGLKVDPKKYRKMKERLVGVSEETTTGVKRLYQMQASGALLFPAINVNDSVTKSKFDNLYGCRHSLPDGLMRATDVMIAGKVAVVCGYGDVGKGCAAALKQAGARVIVTEIDPICALQALMGGLPVLTLEDVVSEADIFVTTTGNKDIIMVDHMKKMKNNAIVCNIGHFDNEIDMHGLETYPGVKRITIKPQTDRWVFPETKTGIIVLAEGRLMNLGCATGHPSFVMSCSFTNQVIAQLELWKEKATGKYEKKVYVLPKHLDEKVAALHLGKLGAKLTKLTPSQADYISVPIEGPYKPAHYRY

SEQ ID NO: 13987 - protein, 485 aa, Elaeis guineensis
  misc_feature (123)..(123): Xaa can be any naturally occurring amino acid
  misc_feature (129)..(129): Xaa can be any naturally occurring amino acid
  misc_feature (163)..(163): Xaa can be any naturally occurring amino acid
  misc_feature (182)..(182): Xaa can be any naturally occurring amino acid
  misc_feature (185)..(185): Xaa can be any naturally occurring amino acid
  misc_feature (193)..(194): Xaa can be any naturally occurring amino acid
MALLVEKTSSGREYKVKDLSQADFGRLEIELAEVEMPGLMACRAEFGPSQPFKGARISGSLHMTIQTAVLIETLTALGAEVRWCSCNIFSTQDHAAAAIARDSAAVFAWKGETLQEYWWCTEXCLDWGXAGGPDLIVDDGGDATLLIHEGVKAEEEYEKTGKXPDPASTDNAEFQIVLGLIXDSXKVDPKKYXXMKERLVGVSEETTTGVKRLYQMQASGTLLFPAINVNDSVTKSKFDNLYGCRHSLPDGLMRATDVMIAGKVAVVCGYGDVGKGCAAALKQAGARVIVTEIDPICALQALMEGIPVLTLEDVVSEADIFVTTTGNKDIIMVNHMRKMKNNAIVCNIGHFDNEIDMHGLETYPGVKRITIKPQTDRWVFPDTNSGIIVLAEGRLMNLGCATGHPSFVMSCSFTNQVIAQLELWKERASGKYEKKVYVLPKHLDEKVAALHLGKLGAKLTKLTPAQAEYISVPIEGPYKPPHYRY

SEQ ID NO: 13988 - protein, 485 aa, Picea glauca
MALLAEKTVSGREYKVKDMSQADFGRLEIELAEVEMPGLMACRVEFGPAQPFKGARITGSLHMTIQTAVLIETLTALGAEVRWCSCNIFSTQDHAASAIARDSAAVFAWKGETLQEYWWCTERALDWGPGGGPDLIVDDGGDTTLLIHEGVKAEEEFAKTGKVPDPASTTNVEFQIVLALIKESLKVDPLRYHRMKDRIVGVSEETTTGVKRLYQMQNSGSLLFPAINVNDSVTKSKFDNLYGCRHSLPDGLMRATDVMIAGKVAVVCGYGDVGKGCAAAMKVAGARVIVTEIDPICALQALMEGLPVLTLEDVVSTADIFVTTTGNKDIIMLDQMRKMKNNAIVCNIGHFDNEIDMQGLENFPGVKKITIKPQTDRWVFPDTKSGIIVLAEGRLMNLGCATGHPSFVMSCSFTNQVIAQLELWNERKSGKYEKKVYVLPKHLDEKVAALHLPKLGAKLTKLSPDQAEYINVPVEGPYKPAHYRY

SEQ ID NO: 13989 - protein, 485 aa, Eschscholzia californica
MALIVEKTASGREYKVKDMSQADFGRLELELAEVEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYEKSGKIPDPTSTDNPEFQIVLQIIKDGLKEDPKKYHKMKDRLVGVSEETTTGVKRLYQMQQSGTLLFPAINVNDSVTKSKFDNLYGCRHSLPDGLMRATDVMIAGKIALVAGYGDVGKGCAAALKQAGAQVIVTEIDPICALQALMEGIPVQTLDDVVSKVDIFVTTTGNKDIIMVDDMRKMKNNAIVCNIGHFDNEIDMLGLETFPGVKRITIKPQTDRWVFPDTKTGIIILAEGRLMNLGCATGHPSFVMSCSFTNQVIAQLELWNERKTGKYGKEVYVLPKHLDEKVAALHLGKLGAKLTKLSKDQADYISVPVEGPYKPAHYRY

SEQ ID NO: 13990 - protein, 485 aa, Lactuca sativa
MALTVEKTSTGREYKVKDMSLADFGRLELELAEVEMPGLMSCRTEFGPSQPFKGARITGSLHMTIQTGVLIETLTALGAEVRWCSCNIFSTQDHAASAIARDSAAVFAWKGETLQEYWWCTERALDWGPGGGPDLIVDDGGDATLLIHEGVKAEEEFEKTGKLPDPTSTDNAEFQIVLSIIKEGLAVDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLPLEDVVSDADIFVTTTGNKDIIMVSDMRKMKNNAIVCNIGHFDNEIDMLGLETYPGVKRITIKPQTDRWVFPETKTGIIILAEGRLMNLGCATGHPSFVMSCSFTNQVIAQLELWKERTTGKYKKEVYVLPKHLDEKVAALHLAKLGAKLTILSKDQADYINVPVEGPYKPLTYRY

SEQ ID NO: 13991 - protein, 485 aa, Cedrus atlantica
MALLAEKTVSGREYKVKDMSQADFGRLEIELAEVEMPGLMACRVEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKSGKVPDPESTTNVEFQMVLGLIKESIKVDPLRYHRMKDRLVGVSEETTTGVKRLYQMQASGTLLFPAINVNDSVTKSKFDNLYGCRHSLPDGLMRATDVMIAGKVAVVCGYGDVGKGCAAALKVAGARVIVTEIDPICALQALMEGLPVLTLEDVVSTADIFVTTTGNKDIIMLDHMRKMKNNAIVCNIGHFDNEIDMQGLETFPGVKKITIKPQTDRWVFPDTNSGVIVLAEGRLMNLGCATGHPSFVMSCSFTNQVIAQLELWNEKKSGKYEKKVYVLPKHLDEKVAALHLPKLGAKLTKLSPEQAEYINVPVEGPYKPAHYRY

SEQ ID NO: 13992 - protein, 485 aa, Vinca minor
MALSVDKTSSGREYKVKDMSQADFGRLELELAEVEMPGLMACRAEFGSSQPFKGARITGSLHMTIQTGVLIETLTALGASVRWCSCNIFSTQDHAAAAIARDSAAVFAWKGETLQEYWWCTERALDWGSEGGPDLIVDDGGDATLLIHEGVKAEEEYEKTGKVPDPSSTDNAEFQIVLTIIRDGLKADPKKYHKMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGIQVFTLEDVVSEADIFVTTTGNKDIIMVDHMRKMKNNAIVCNIGHFDNEIDMHGLETYPGIKHIAIKPQTDRWVFPETGTGIIVLAEGRLMNLGCATGHPSFVMSCSFTNQVIAQLELWKEKTSGKYEKKVYVLPKHLDEKVAALHLGKLGAKLTKLSPEQADYISVPVDGPYKPAHYRY

SEQ ID NO: 13993 - protein, 475 aa, Setaria italica
MALSVEKTSSGREYKVKDLSQADFGRLEIELAEVEMPGLMACRAEFGPSKPFVSGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKVPDAEFKIVLTIIRDGLKSDPKRYRKMKERLVGVSEETTTGVKRLYQMQETGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMHGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGARLTKLSKSQADYISVPIEGPYKPAHYRY

SEQ ID NO: 13994 - protein, 485 aa, Papaver somniferum
MALVVEKTSTGREYKVKDMSQADFGRLEIELAEVEMPGLMSCRTEFGPSQPFKGARITGSLHMTIQTAVLIETLTALGAEVRWCSCNIFSTQDHAAAVIARDSAAVFAWKGETLQEYWWCTERSLDWGPDGGPDLIVDDGGDVTLLIHEGVKAEEEYEKTGKFPDPTSTDNPEFQIVLTIIKDGLKENPKKYTQMKNRIVGVSEETTTGVKRLYQMEQTGTLLFPAINVNDSVTKSKFDNLYGCRHSLPDGLMRATDVMIAGKVAVVCGYGDVGKGCASALKQAGARVIVTEIDPICALQALMEGLQVLTLEDAISEADIFVTTTGNKDIIMVSDMKKMKNNAIVCNIGHFDNEIDMNGLETYPGVKRITIKPQTDRWVFPETKTGIIVLAEGRLMNLGCATGHPSFVMSCSFTNQVIAQLELWNEKTSGKYEKKVYVLPKHLDEKVALLHLGKLGANLTRLSKDQADYISVPVDGPYKPAHYRY

SEQ ID NO: 13995 - protein, 485 aa, Triticum aestivum
MALSVEKTASGREYKVKDLSQADFGRLELELAEVEMPGLMACRAEFGPSQPFKGARISGSLHMTIQTAVLIETLTALGAEVRWCSCNIFSTQDHAAAAIARDSAAVFAWKGETLEEYWWCTERCLDWGAGGGPDLIVDDGGDATLLIHEGVKAEEEFERSGKVPDPDSTDNPEFKIVLTIIRDGLKTDARKYRKMKERLVGVSEETTTGVKRLYQMQESGTLLFPAINVNDSVTKSKFDNLYGCRHSLPDGLMRATDVMIAGKVAVVCGYGDVGKGCAAALKQAGARVIVTEIDPICALQALMEGIQILTLEDVVSDADIFVTTTGNKDIIMVDHMRKMKNNAIVCNIGHFDNEIDMNGLETYPGVKRITIKPQTDRWVFPETNTGIIVLAEGRLMNLGCATGHPSFVMSCSFTNQVIAQLELWKEKATGKYEKKVYVLPKHLDEKVAALHLGKLGARLTKLTKAQSEYISIPVDGPYKPAAYRY

SEQ ID NO: 13996 - protein, 485 aa, Pseudotsuga menziesii
MALISEKTVSGREYKVKDMSQADFGRLEIELAEVEMPGLMACRAEFGPAQPFKGAQITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKTGKVPDPESTNNLEFQMVLGLIKESIKVDPLRYHRMKDRLVGVSEETTTGVKRLYQMQASGTLLFPAINVNDSVTKSKFDNLYGCRHSLPDGLMRATDVMIAGKVAVVCGYGDVGKGCAAALKVAGARVIVTEIDPICALQALMEGLPVLTLEDVVSTADIFVTTTGNKDIIMLDHMRKMKNNAIVCNIGHFDNEIDMQGLETFPGVKKITIKPQTDRWVFPDTNSGIIVLAEGRLMNLGCATGHPSFVMSCSFTNQVIAQLELWNEKKSGKYEKKVYVLPKHLDEKVAALHLPKLGANLTKLSPEQAEYINVPVEGPYKPAHYRY

SEQ ID NO: 13997 - protein, 485 aa, Podocarpus macrophillus
MALLVEKTVAGREYKVKDMSQADFGRLEIDLAEVEMPGLMACRAEFGPTQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKSGTLPDPSSTTNPEFQIVLGLIKDSLKVDPQRYQKMKQRLVGVSEETTTGVHRLYQMQANGSLLFPAINVNDSVTKSKFDNLYGCRHSLPDGLMRATDVMIAGKVAVVCGYGDVGKGCAAAMKAAGARVIVTEIDPICALQALMEGIPVLTLEDVVSTADIFVTTTGNKDIIMVDHMRKMKNNAIVCNIGHFDNEIDMHGLETYPGVKKITIKPQTDRWVFPETNTGIIVLAEGRLMNLGCATGHPSFVMSCSFTNQVIAQLELWNERKSGKYEKKVYVLPKHLDEKVAALHLPKLGAKLTKLTPDQAAYINVPAEGPYKPAHYRY

SEQ ID NO: 13998 - protein, 485 aa, Lactuca sativa
MALTVEKTSTGREYKVKDMSLADFGRLELELAEVEMPGLMSCRTEFGPSQPFKGARITGSLHMTIQTGVLIETLTALGAEVRWCSCNIFSTQDHAASAIARDSAAVFAWKGETLQEYWWCTERALDWGPGGGPDLIVDDGGDATLLIHEGVKAEEEFEKTGKLPDPTSTDNAEFQIVLSIIKEGLAVDPKKYHKMKDRLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLPLEDVVSDADIFVTTTGNKDIIMVSDMRKMKNNAIVCNIGHFDNEIDMLGLETYPGVKRITIKPQTDRWVFPETKTGIIILAEGRLMNLGCATGHPSFVMSCSFTNQVIAQLELWKERTTGKYKKEVYVLPKHLDEKVAALHLAKLGAKLTILSKDQADYINVPVEGPYKPLTYRY

SEQ ID NO: 13999 - protein, 485 aa, Gossypium hirsutum
MALSVDKTSGGREYKVKDMSQADFGRLEIDLAEVEMPGLMACRTEFGPSQPFKGAKITGSLHMTIQTAVLIETLTALGAEVRWCSCNIFSTQDHAAAVIARDSASVFAWKGETLQEYWWCTEKSLDWGAGGGPDLIVDDGGDVTMLIHEGVKAEEAYEKTGKVPDPTSSDNAEFQIVLTIIKDGLTANPKKYTKMKERLVGVSEETTTGVKRLYQMQANGTLLFPAINVNDSVTKSKFDNLYGCRHSLPDGLMRATDVMIAGKVAVVCGYGDVGKGCASALKQAGARVIVTEIDPICALQALMEGLQVLTLEDVLSTADIFVTTTGNKDIIMVDHMKKMKNNAIVCNIGHFDNEIDMLGLENYPGVKRITIKPQTDRWVFPDTKTGIIVLAEGRLMNLGCATGHPSFVMSCSFTNQVIAQLELWKEKSTGKYEKKVYVLPKHLDEKVASLHLGKLGAKLTKLTKDQADYISVPIEGPYKPPNYRY

SEQ ID NO: 14000 - protein, 485 aa, Pseudotsuga menziesii
MALLAEKTVSGREYKVRDLSQADFGRLEIELAEVEMPGLMASRVEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEEEFAKTGKVPDPASTTNPEFQIVLGLIKESLKVDPLRYHRMKDRIVGVSEETTTGVKRLYQMQNSGSLLFPAINVNDSVTKSKFDNLYGCRHSLPDGLMRATDVMIAGKVAVVCGYGDVGKGCAAAMKVAGARVIVTEIDPICALQALMEGLPVLTLEDVVSTADIFVTTTGNKDIIMLEHMRKMKNNAIVCNIGHFDNEIDMQGLESFPGVKKITIKPQTDRWVFPDTKSGIIVLAEGRLMNLGCATGHPSFVMSCSFTNQVIAQLELWNERKSGKYEKQVYVLPKHLDEKVAALHLPKLGAKLTKLSPDQAAYINVPVEGPYKPTHYRY

SEQ ID NO: 14001 - protein, 485 aa, Orobanche aegyptiaca
MALLVEKTTCGREYKVKDMSQADFGRLEIELAEVEMPGLMSCRYEFGPSQPFKGAKITGSLHMTIQTAVLIETLTALGAEVRWCSCNIFSTQDHAAAAIARDSAAVFAWKGETLQEYWWCTERALDWGPSGGPDLIVDDGGDATLLIHEGVKAEEEYMKSGKLPDPSSTDNSEFQIVLTIIRDGLKVDPKKYTRLKERLVGVSEETTTGVKRLYQMQANGTLLFPAINVNDSVTKSKFDNLYGCRHSLPDGLMRATDVMIAGKMGVVCGYGDVGKGCAVALKQAGARVIVTEIDPICALQALMEGFQVLTLEDVVSEADIFVTTTGNKDIIMVDHMKKMKNNAILCNIGHFDNEIDMLGLETFPGVKRIMIKPQTDRWVFPETNTGIIVLAEGRLMNLGCATGHPSFVMSCSFTNQVIAQLELWKERNTGKYGKKVYVLPKHLDEKVAALHLGKLGAKLTKLTKDQAVYIGVPVEGPYKPLHYRY

SEQ ID NO: 14002 - protein, 485 aa, Selaginella moellendorffii
MALSVEKTAAGREYKVKDMSQADFGRLEIELAEVEMPGLMACRTEFGPAQPFKGARITGSLHMTIQTAVLIETLTALGAEVRWCSCNIFSTQDHAAAAIARDSAAVFAWKGENLQEYWWCTERALDWGVGGGPDLIVDDGGDATLLIHEGVKAEKEFEKNGTLPDPSSTTNQEFQIVLGILKEGLQVDPKRYHKMMERLVGVSEETTTGVKRLYQMQSNGSLLFPAINVNDSVTKSKFDNLYGCRHSLPDGLMRATDVMIAGKVAVVAGYGDVGKGCASAMKAAGARVIVTEIDPICALQALMEGLEVLTLEDVVSVADIFVTTTGNKDIIMVDHMKKMKNNAIVCNIGHFDNEIDMLGLETYPGVKRITIKPQTDRWVFPETGTGIIVLAEGRLMNLGCATGHPSFVMSCSFTNQVIAQLELWNERKSGKYEKKVYVLPKHLDEKVAALHLPKLGAKLTKLSADQAAYINVPVEGPYKPAHYRY

SEQ ID NO: 14003 - protein, 259 aa, Triticum aestivum
DPIHQPPPGALRGEDRVGPGVQGEGPLPGRLRPPRARARRGRDARPHGLPRRVRALAALQGARISGSLHMTIQTAVLIETLTALGAEVRWCSCNIFSTQDHAAAAIARDSAAVFAWKGETLEEYWWCTERCLDWGVGGGPDLIVDDGGDATLLIHEGVKAEEEFEKSGKVPDPESTDNPEFKIVLTIIRDGLKTDASKYRKMKERLVGVSEETTTGVKRLYQMQESGTLLFPAINVNDSVTKSKFDNLYGCRTRSLMVL

SEQ ID NO: 14004 - protein, 485 aa, Amorphophallus konjac
MALQVEKTTSGREYKVKDMSQADFGRLEIELAEVEMPGLMSCRAEFGPSQPFKGARISGSLHMTIQTAVLIETLTALGAEVRWCSCNIFSTQDHAAAAIARDSAAVFAWKGETLQEYWWCTERCLDWGAGGGPDLIVDDGGDATLLIHEGVKAEEEYEKSGKLPDPSSTDNAEFQIVLGLIRDGLKVDPRRYRKMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLPVLTLEDVVAEADIFVTTTGNKDIVMVDHMRKMKNNAIVCNIGHFDNEIDMHGLETFPGVKRITIKPQTDRWVFPDTNSGIIVLAEGRLMNLGCATGHPSFVMSCSFTNQVIAQLELWKERSSGKYEKEVYVLPKHLDEKVAALHLEKLGAKLTKLTPSQAEYINVSPDGPFKPPRYRY

SEQ ID NO: 14005 - protein, 439 aa, Brassica napus
MALLVEKTSSGREYKVKDMSQADFGRLEIELAEVEMPGLVSCRTEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPSSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMQGLETFPGVKRITIKPQTDRWVFPDTKSGIIVLAEGRLMNLGCATGHPSFVMSCSFTNQVIAQLERWNEKSSGKYEKKYMFA

SEQ ID NO: 14006 - protein, 476 aa, Pteridium aquilinum
MSLLVEKTSSGREYKVKDMSQADFGRLEIELAEVEMPGLMACRTEFGPSQPFKGAKITGSLHMTIQTAVLIETLTALGAEVRWCSCNIFSTQDHAASAIARDSAAVFAWKGETLQEYWWCTERALDWGPTGGPDLIVDDGGDATLLIHEGVKAEEVYEKTGQLPDPASTDNAEFQIVLTIIRDGLKTDRKKYTRMKNRLVGVSEETTTGVKRLYQMQANGSLLFPAINVNDSVTKSKFDNLYGCRHSLPDGLMRATDVMIAGKVAVVCGYGDVGKGCAAALKQAGARVIVTEIDPICALQALMEGLQVLTLEDVVCEADIFVTTTGNKDIIMVDHMRKMKNNAIVCNIGHFDNEIDMCGLENYPGVKRITIKPQTDRWVFPDTNSGIIVLAEGRLMNLGCATGHPSFVMSCSFTNQVIAQLELWNEKATGKYEKKVYVLPKHLDEKVAALHLPKLGAKLTKLSKEQADYISVPVEG

SEQ ID NO: 14007 - protein, 485 aa, Cicer arietinum
MSLIVEKTNTGREYKVKDLSQADFGRLEIELAEIEMPGLISSRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDVTLLIHEGVKAEELFEKTGEVPDPSSTDNAEFQIVLSIIREGLKTDPQRYRKMKQRLVGVSEETTTGVKRLYQMQANGTLLFPAINVNDSVTKSKFDNLYGCRHSLPDGLMRATDVMIAGKVGVVCGYGDVGKGCAVALKQAGARVIVTEIDPICALQALMEGFQVLTLEDVVSIADIFVTTTGNKDIIMVDDMRKMKNNAIVCNIGHFDNEIDMAGLENYPGVKRITIKPQTDRWVFPETNTGIIVLAEGRLMNLGCATGHPSFVMSCSFTNQVIAQLELWNERNSGKYEKKVYVLPKHLDEKVAALHLNKLGAKLTKLSQSQADYISVPVEGPYKPAHYRY

SEQ ID NO: 14008 - protein, 485 aa, Trifolium pratense
MSLTVEKTTAGREYKVKDLSQADFGRLEIELAEIEMPGLISCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGEVPDPSSTDNVEFQLVLTIIRDGLKTDPQRYRKMKERLVGVSEETTTGVKRLYQMQANGTLLFPAINVNDSVTKSKFDNLYGCRHSLPDGLMRATDVMIAGKVGVVCGYGDVGKGCAVALKQAGARVIVTEIDPICALQALMEGFQVLTLEDVVSYADIFVTTTGNKDIIMVDDMKKMKNNAIVCNIGHFDNEIDMSGLENYPGVKRITIKPQTDRWLFPETNTGIIVLAEGRLMNLGCATGHPSFVMSCSFTNQVIAQLELWNERKSGKYEKKVYVLPKHLDEKVAALHLGKLGAKLTKLSQSQADYISVPVEGPYKPAHYRY

SEQ ID NO: 14009 - protein, 485 aa, Sciadopitys verticillata
MALVVEKTVTGREYKVKDMSQADFGRLEIDLAEVEMPGLMACRVEFGPSQPLKGARITGSLHMTIQTAVLIETLTALGAEVRWCSCNIFSTQDHAAAAIARDSAAVFAWKGETLQEYWWCTERALGWGPGGGPDLIVDDGGDATLLIHEGVKAEEEFAKTGKLPDPSSTTNPEFQIVLGLIRDTLKEDPLKYHKMKDRLVGVSEETTTGVHRLYQMQNNGSLLFPAINVNDSVTKSKFDNLYGCRHSLPDGLMRATDVMIAGKVAVVCGYGDVGKGCAAAMKAAGARVIVTEIDPICALQALMEGLPVLTLEDVVSTADIFVTTTGNKDIIMVDDMRKMKNNAIVCNIGHFDNEIDMHGLETYPGVKKITIKPQTDRWVFPETNTGIIILAEGRLMNLGCATGHPSFVMSCSFTNQVIAQLELWNERKTGKYEKKVYVLPKHLDEKVAALHLPKLGARLTKLSADQAAYINVPVEGPYKPAHYRY

SEQ ID NO: 14010 - protein, 281 aa, Pinus taeda
MALYTEKTVSGREYKVKDMSQADFGRLEIELAEVEMPGLMACRAEFGPAQPFKGARITGSLHMTIQTAVLIETLTALGADVRWCSCNIFSTQDHAAAAIARDSAAVFAWKGETLQEYWWCTERALDWGPGGGPDLIVDDGGDTTLLIHEGVKAEEEFAKTGKVPDPSSTTNAEFQIVLALIKESLKVDPLRYHRMKDRIVGVSEETTTGVKRLYQMQNAGSLLFPAINVNDSVTKSKFDNLYGCRHSLPDGLMRATDVMIAGKWVWRCWQGLCCSFESRWS

SEQ ID NO: 14011 - protein, 485 aa, Sequoia sempervirens
MALLVEKTVTGREYKVKDLSQADFGRMELDLAEVEMPGLMACRAEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKTGKIPDPTSTTNPEFQIVLGLIKDSLKEDPLKYHKMKDRLVGVSEETTTGVHRLYQMQASGSLLFPAINVNDSVTKSKFDNLYGCRHSLPDGLMRATDVMIAGKVGVVCGYGDVGKGCAAALKAAGARVIVTEIDPICALQALMEGIPVLTLEDVVSTADIFVTTTGNKDIIMVDDMRKMKNNAIVCNIGHFDNEIDMHGLETYPGVKKITIKPQTDRWVFPETNSGIIVLAEGRLMNLGCATGHPSFVMSCSFTNQVIAQLELWNERKTGKYEKKVYVLPKHLDEKVAALHLPKLGARLTKLSPDQAAYINVPVEGPYKPVHYRY

SEQ ID NO: 14012 - protein, 485 aa, Vitis vinifera
MALVVEKTTSGREYKVKDMSQADFGRLEIELAEVEMPGLMACRTEFGPQQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYERSGKLPDPASTDNAEFQIVLGIIKEGLSVDPCKYRKMKERLVGVSEETTTGVKRLYQMQANGTLLFAAINVNDSVTKSKFDNLYGCRHSLPDGLMRATDVMIAGKVAVVCGYGDVGKGCAAALKQAGAQVIVTEIDPICALQALMEGIPVLTLEDVVSKADIFVTTTGNKDIIMVHHMKQMKNNAIVCNIGHFDNEIDMLGLETYPGVKRITIKPQTDRWVFPETNSGIIILAEGRLMNLGCATGHPSFVMSCSFTNQVIAQLELWKEKATGKYEKKVYVLPKHLDEKVAALHLGKLGAKLTKLSPEQAAYISVPVEGPYKPTHYRY

SEQ ID NO: 14013 - protein, 485 aa, Sequoia sempervirens
MALVVEKTVTGREYKVKDMSQADFGRMELDLAEVEMPGLMACRVEYGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKTGKLPDPSSTTNPEFQIVLGLIKDGLKEDPLKYHKMKDRLVGVSEETTTGVHRLYQMQNNGTLLFPAINVNDSVTKSKFDNLYGCRHSLPDGLMRATDVMIAGKVAVVCGYGDVGKGCAAAMKAAGARVIVTEIDPICALQALMEGIPVLTLEDVLDTADIFVTTTGNKDIIMVDHMRKMKNNAIVCNIGHFDNEIDMHGLETYPGVKKVTIKPQTDRWVFPETNSGIIVLAEGRLMNLGCATGHPSFVMSCSFTNQVIAQLELWNERKTGKYEKKVYVLPKHLDEKVAALHLPKLGAKLTKLSPDQAAYINVPVEGPYKPVHYRY

SEQ ID NO: 14014 - protein, 485 aa, Abies balsamea
MALFAEKTVSGREYKVKDLSQADFGRLEIELAEVEMPGLMASRVEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDTTLLIHEGVKAEAEFAKNGKVPDPASTTNVEFQIVLALIRESLKVDPLRYHRMKDRLVGVSEETTTGVKRLYQMQNAGSLLFPAINVNDSVTKSKFDNLYGCRHSLPDGLMRATDVMIAGKVAVVCGYGDVGKGCAAAMKVAGARVIVTEIDPICALQALMEGLPVLTLDDVVSSADIFVTTTGNKDIIMLEHMRKMKNNAIVCNIGHFDNEIDMQGLESFPGVKKITIKPQTDRWVFPDTNSGIIVLAEGRLMNLGCATGHPSFVMSCSFTNQVIAQLELWNERKSGKYEKKVYVLPKHLDEKVAALHLPKLGAKLTKLTPDQAEYINVPVEGPYKPAHYRY

SEQ ID NO: 14015 - protein, 485 aa, Abies balsamea
MALLAEKTVSGREYKVKDLSQADFGRLELELAEVEMPGLMACRSEFGPAQPFKGARITGSLHMTIQTAVLIETLTALGAEVRWCSCNIFSTQDHAAAAIARDSCAVFAWKGETLQEYWWCTERALDWGPGGGPDLIVDDGGDATLLIHEGVKAEEEFAKTGKVPDPESTTNVEFQMVLGLIKESIKVDPLRYHRMKERLVGVSEETTTGVKRLYQMQASGTLLFPAINVNDSVTKSKFDNLYGCRHSLPDGLMRATDVMIAGKVAVVCGYGDVGKGCAAALKVAGARVIVTEIDPICALQALMEGLPVLPIEDVVSTADIFVTTTGNKDIIMLHHMRKMKNNAIVCNIGHFDNEIDMQGLETFPGVKKITIKPQTDRWVFPDTNSGIIVLAEGRLMNLGCATGHPSFVMSCSFTNQVIAQLELWNERKSGKYEKKVYVLPKHLDEKVAALHLPKLGAKLTKLSPEQAEYINVPVEGPYKPVHYRY

SEQ ID NO: 14016 - protein, 485 aa, Cucumis sativus
MSLLVDKTSTGREYKVKDMAQADFGRLEIDLAEVEMPGLMACRTEYGPALPFKGAKITGSLHMTIQTAVLIETLTALGAEVRWCSCNIFSTQDHAAAAIARDSAAVFAWKGETLQEYWWCTERSLDWGPEGGPDLIVDDGGDVTLLIHEGVKAEEIYEKTGTLPDPSSTTNSELQIVFTIIRDGLKTDPKRYHKMKERLVGVSEETTTGVKRLYQMQANGTLLFPAINVNDSVTKSKFDNLYGCRHSLPDGLMRATDVMIAGKVAVVCGYGDVGKGCAFALKQGGARVIVTEIDPICALQALMEGFQVLTLNDVVSEADIFVTTTGNKDIIMVSDMRKMKNNAIVSNIGHFDNEIDMHGLETFPDVKRITIKPQTDRWVFPDTKTGIIVLAEGRLMNLGCATGHPSFVMSCSFTNQVIAQLELWNERKTGKYEKKVYVLPKHLDEKVAALHLGKLGAKLTKLSKDQADYISVPIEGPYKPAHYRY

SEQ ID NO: 14017 - protein, 485 aa, Medicago truncatula
MSLTVEKTQAGREYKVRDLSQADFGRLEIELAEIEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGEVPDPSSTDNAEFQLVLTIIRDGLKTDPKRYRKMKDRLVGVSEETTTGVKRLYQMQASGTLLFPAINVNDSVTKSKFDNLYGCRHSLPDGLMRATDVMIAGKVGVVAGYGDVGKGCAVALKQAGARVIVTEIDPICALQALMEGFQVLTLDDVVSYADIFVTTTGNKDIIMVDDMRKMKNNAIVCNIGHFDNEIDMSGLENYPGVKRVTIKPQTDRWVFPETNTGIIVLAEGRLMNLGCATGHPSFVMSCSFTNQVIAQLELWNERKSGKYEKKVYVLPKHLDEKVAALHLGKLGAKLTKLSQSQADYISVPVEGPYKPAHYRY

SEQ ID NO: 14018 - protein, 485 aa, Aristolochia fimbriata
MSLSVEKTSSGREYKVKDMSQADFGRLEIDLAEVEMPGLMACRAEFGPQKPFAGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYAKTGKLPDPASTDNAEFQIVLTIIRDGLKADPTRFHKMKDRIVGVSEETTTGVKRLYQMQAAGTLLFPAINVNDSVTKSKFDNLYGCRHSLPDGLMRATDVMIAGKVAVVCGYGDVGKGCAAALKQAGARVIVTEIDPICALQALMEGIPVLTLEDVVGEADIFVTTTGNKDIIMVSHMRKMKNNAIVCNIGHFDNEIDMLGLENYPGVKRITIKPQTDRWVFPDTKSGIIVLAEGRLMNLGCATGHPSFVMSCSFTNQVIAQLELWKEKASGKYEKEVYVLPKHLDEKVAALHLPKLGAKLTKLSPDQAEYIHVSVEGPYKPPHYRY

SEQ ID NO: 14019 - protein, 485 aa, Distylium racemosum
MALLVEKTVAGREYKVKDMSQADFGRLEIDLAEVEMPGLMACRAEFGPAQPLKGTRITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEIEFAKNGAIPDPSSTTNPEFQLVLGLIKESLKEDPMKYHKMKDRLVGVSEETTTGVHRLYQMQANGTLLFPAINVNDSVTKSKFDNLYGCRHSLPDGLMRATDVMIAGKVGVVCGYGDVGKGCAAALKAAGARVIVTEIDPICALQALMEGLPVLTLEDVVSTADIFVTTTGNKDIIMVDDMKKMKNNAIVCNIGHFDNEIDMHGLETYPGVKKITIKPQTDRWVFPETNSGIIVLAEGRLMNLGCATGHPSFVMSCSFTNQVIAQLELWNERKSGKYEKKVYVLPKHLDEKVAALHLPKLGARLTKLSPDQAAYINVPVEGPYKPAHYRY

SEQ ID NO: 14020 - protein, 486 aa, Vitis vinifera
MALVVEKTTSGREYKVKDMSQADFGRLEIELAEVEMPGLMACRTEFGPQQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYERSGKLPDPASTDNAEFQIVLGIIKEGLSVDPCKYRKMKERLVGVSEETTTGVKRLYQMQANGTLLFAAINVNDSVTKSKVMDNLYGCRHSLPDGLMRATDVMIAGKVAVVCGYGDVGKGCAAALKQAGAQVIVTEIDPICALQALMEGIPVLTLEDVVSKADIFVTTTGNKDIIMVHHMKQMKNNAIVCNIGHFDNEIDMLGLETYPGVKRITIKPQTDRWVFPETNSGIIILAEGRLMNLGCATGHPSFVMSCSFTNQVIAQLELWKEKATGKYEKKVYVLPKHLDEKVAALHLGKLGAKLTKLSPEQAAYISVPVEGPYKPTHYRY

SEQ ID NO: 14021 - protein, 479 aa, Platanus occidentalis
KTSSGREYKVKDMSQADFGRLEIELAEVEMPGLMSCRSEFGPSQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKNGKIPDPASTDNAEFQIVLGIIRDGLKVDPKKYHKMKERLVGVSEETTTGVKRLYQMQANGSLLFPAINVNDSVTKSKFDNLYGCRHSLPDGLMRATDVMIAGKIAVVCGYGDVGKGCASAMKQAGARVIVTEIDPICALQALMEGIAVRTLEDVVAEGDIFVTTTGNKDIIMLHHMKKMKNNAIVCNIGHFDNEIDMLGLENYPGVKRITIKPQTDRWVFPETNSGIIVLAEGRLMNLGCATGHPSFVMSCSFTNQVIAQLELWKERATGKYEKKVYVLPKHLDEKVAALHLGKLGAKLTKLTPAQAEYISVPVEGPYKPPQYRY

SEQ ID NO: 14022 - protein, 485 aa, Trigonella foenum-graecum
MSLTVEKTQTGREYKVRDLSQADFGRLELELAEIEMPGLMSCRTEFGPSQPFKGARITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEELFEKTGEVPDPTSTDNVEFQLVLTIIRDGLKTDPKRYRKMKERLVGVSEETTTGVKRLYQMQANGTLLFPAINVNDSVTKSKFDNLYGCRHSLPDGLMRATDVMIAGKVGVVAGYGDVGKGCAVALKQAGARVIVTEIDPICALQALMEGFQVLTLDDVVSYADIFVTTTGNKDIIMVDDMRKMKNNAIVCNIGHFDNEIDMSGLENYPGVKRVTIKPQTDRWVFPETNTGIIVLAEGRLMNLGCATGHPSFVMSCSFTNQVIAQLELWNERKSGKYEKKVYVLPKHLDEKVAALHLGKLGAKLTKLSQSQADYISVPVEGPYKPAHYRY

SEQ ID NO: 14023 - protein, 485 aa, Cephalotaxus harringtonia
MALLVEKTVAGREYKVKDMSQADFGRMELDLAEVEMPGLMACRVEYGPSQPFKAARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKTGKIPDPTSTTNPEFQIVLGLIRDTLKEDPLKYHKMKDRLVGVSEETTTGVHRLYQMQANGSLLFPAINVNDSVTKSKFDNLYGCRHSLPDGLMRATDVMIAGKVAVVCGYGDVGKGCAAAMKAAGARVIVTEIDPICALQALMEGIPVLTLEDVVDTADIFVTTTGNKDIIMVDHMRKMKNNAIVCNIGHFDNEIDMLGLETYPGVKKITIKPQTDRWVFPETNSGIIVLAEGRLMNLGCATGHPSFVMSCSFTNQVIAQLELWNERKTGKYEKKVYVLPKHLDEKVAALHLPKLGAKLTKLSPEQAAYINVPVVGPYKPTHYRY

SEQ ID NO: 14024 - protein, 467 aa, Gossypium hirsutum
MSQADFGRLEIELAEVEMPGLMACRTEFGPAQPFKGAKITGSLHMTIQTAVLIETLTALGAEVRWCSCNIFSTQDHAAAAIARDSAAVFAWKGETLQEYWWCTERALDWGPTGGPDLIVDDGGDATLLIHEGVKAEEVYEKTGQLPDPASTDNAEFQIVLTIIRDGLKADPKKYRRMKERLVGVSEETTTGVKRLYQMQANGTLLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWKEKATGKYEKKVYVLPKHLDEKVAALHLGKLGAKLTKLTKDQADYISVPVEGPYKPPHYRY

SEQ ID NO: 14025 - protein, 485 aa, Cycas rumphii
MALIVEKTVSGREFKVRDLSQADFGRLEIELAEVEMPGLMSCRAEFGPSQPFKGARITGSLHMTIQTAVLIETLTALGAEVRWCSCNIFSTQDHAAAATARDSAAVFAWKGETLQEYWWCTERALDWGPGGGPDLIVDDGGDATLLIHEGVKAEEEYAKTGKIPDPSSTTNLEMQIVLGLIKDSLQEDPQKYHKIKDRLVGVSEETTTGVKRLYQMQANGSLLFPAINVNDSVTKSKFDNLYGCRHSLPDGLMRATDVMIAGKVGVVCGYGDVGKGCAAALKAAGARVIVTEIDPICALQALMEGIPVLTLEDVLSTADIFVTTTGNKDIIMVDHMRRMKNNAIVCNIGHFDNEIDVQGLETYPGIKRITIKPQTDRWVFPETNTGIIVLAEGRLMNLGCATGHPSFVMSCSFTNQVIAQLELWNERRSGKYKKEVYVLPKHLDEKVAALHLDKLGAKLTKLTPSQAAYINVPIEGPYKPVHYRY

SEQ ID NO: 14026 - protein, 194 aa, Amorphophallus konjac
MALSVEKTSSGREYKVKDMSQADFGRLEIELAEVEMPGLMACRKEFGPAQPFKGARISGSLHMTIQTAVLIETLTALGAEVRWCSCNIFSTQDHAAAAIARDSAAVFAWKGETLQEYWWCTERCLDWGADGGPDLIVDDGGDATLLIHEGVKAEEEYEKSGKVPDPASTDNAEFQLVLGIIRDGLKADPRGTGR

SEQ ID NO: 14027 - protein, 485 aa, Cephalotaxus harringtonia
MALLVEKTVTGREFKVKDLSQADFGRMELDLAEVEMPGLMACRVEFGPTQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGFKAEEEFAKTGKIPDPTSTTNPEFQIVLGLIKDSLKEDPMKYHKMKDRLVGVSEETTTGVHRLYQMQANGSLLFPAINVNDSVTKSKFDNLYGCRHSLPDGLMRATDVMIAGKVAVVCGYGDVGKGCAAALKVAGARVIVTEIDPICALQALMEGLPVLTLQDVVSTADIFVTTTGNKDIIMVDDMRKMKNNAIVCNIGHFDNEIDMTGLETYPGVKKITIKPQTDRWVFPETNSGIIVLAEGRLMNLGCATGHPSFVMSCSFTNQVIAQLELWNERKTGKYEKKVYVLPKHLDEKVAALHLPKLGARLTKLSPEQAAYINVPVEGPYKAAHYRY

SEQ ID NO: 14028 - protein, 485 aa, Zingiber officinale
MALIVEKTSAGREYKVKDLSQADFGRLEIELAEVEMPGLMACRSEYGPSKPFAGARISGSLHMTIQTAVLIETLTALGAEVRWCSCNIFSTQDHAAAAIARDSAAVFAWKGETLAEYWWCTERALDWGTGGGPDLIVDDGGDATLLIHEGVKAEEEYEKSGKLPDPASTDNVEFQLVLGIIRDGLKVDPKKYHKMKERLVGVSEETTTGVKRLYQMQASGSLLFPAINVNDSVTKSKFDNLYGCRHSLPDGLMRATDVMIAGKVGVVCGYGDVGKGCAAALKQAGARVIVTEIDPICALQALMEGIPVLPLEDVVAEADIFVTTTGNKDIIMVDHMKKMKNNAIVCNIGHFDNEIDMHGLETYPGIKRITIKPQTDRWVFPKTNSGIIVLAEGRLMNLGCATGHPSFVMSCSFTNQVIAQLELWKERKSGKYEKKVYVLPKHLDEKVAALHLGKLGAKLTKLTPEQAEYINVAVEGPYKPAHYRY

SEQ ID NO: 14029 - protein, 485 aa, Coffea canephora
MALSVEKTSSGREYKVKDLSQADFGRLEIELAEVEMPGLMACRAEFGPSQPLKGARITGSLHMTIQTAVLIETLTALGASVRWCSCNIFSTQDHAAAAIARDSAAVFAWKGETLQEYWWCTERALDWGSEGGPDLIVDDGGDATLLIHEGVKAEEEYEKTGKLPDPSSTENAEFQIVLGIIRDGLKVDPKKYHKMKGRLVGVSEETTTGVKRLYQMQANGTLLFSAINVNDSVTKSKFDNLYGCRHSLPDGLMRATDVMIAGKVAVVCGYGDVGKGCAAALKSAGARVIVTEIDPICALQALMEGIPVLTLEDVVSKADIFVTTTGNKDIIMVDHMKKMKNNAIVCNIGHFDNEIDMLGLENYPGVKRVTIKPQTDRWIFPENETGIIILAEGRLTNLGCATGHPSFVMSCSFTNQVIAQLELWKEKATGKYEKKVYVLPKHLDEKVAALHLGKLGAKLTKLTSGQAAYINVPVEGPYKPPHYRY

SEQ ID NO: 14030 - protein, 111 aa, Phalaenopsis aphrodite
MLGLESFPGVKRITIKPQTDRWVFPDTNSGILVLAEGRLMNLGCATGHPSFVMSCSFTNQVIAQLELWKERASGKYEKKVYVLPKHLDEKVAALQFRQAWGQAHQAYLLAG

SEQ ID NO: 14031 - protein, 457 aa, Flaveria ramosissima
MSLTVEKTSTGREYKVKDMSLADFGRLELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPNSTDNAEFQIVLSIIKEGLQSDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQALMEGLQVLTLEDVLSEADIFVTTTGNKDIIMVDHMKKMKNNAIVCNIGHFDNEIDMLGLETYPGVKRITIKPQTDRWVFPETNSGIIVLAEGRLMNLGCATGHPSFVMSCSFTNQVIAQLELWKEKSSGKYKKEVYVLPKHLDEKVAALHLGKLGA

SEQ ID NO: 14032 - protein, 193 aa, Pinus taeda
MALLAEKTVSGREFKVKDLSQADFGRLEIELAEVEMPGLMACRAEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKTGKVPDPESTTNVEFQMVLGLPQGGSLEVPQDEG

SEQ ID NO: 14033 - protein, 485 aa, Marchantia polymorpha
MELSVEKTSAGREYKVKDMSQADFGRMELDLAEVEMPGLMACRTEFGPSQPLKGTRITGSLHMTIQTAVLIETLTALGAEVRWCSCNIFSTQDHAAAAIARDSAAVFAWKGETLAEYWWCTERALDWGPDGGPDLIVDDGGDATLLIHEGVKAEIEFEKDGTLPDPTSTTNQEFQIVLSILRDGLKEDPKKYHRMKERLVGVSEETTTGVKRLYQMQETGTLLFPAINVNDSVTKSKFDNLYGCRHSLPDGLMRATDIMIAGKSAVIFGYGDVGKGCASAMKAAGARVTVTEIDPICALQACMEGFSVLPLEDVVADADIFVTTTGNKDIIMVSDMIKMKNNAIVCNIGHFDNEIDMLGLETYPGVKKITIKPQTDRWVFPETKKGIIVLAEGRLMNLGCATGHPSFVMSCSFTNQVIAQLELWNERNSGKYEKKVYVLPKHLDEKVAALHLEKLGAKLTKLTADQAAYISVPVEGPYKPAHYRY

SEQ ID NO: 14034 - protein, 485 aa, Phalaenopsis aphrodite
MTLLVEKTSSGREYKVKDISQADFGRLEIELAEVEMPGLMACRAEFGPSQPFKGARISGSLHMTIQTAVLIETLTALGAEVRWCSCNIFSTQDHAAAAIARDSAAVFAWKGETLQEYWWCTERCLEWGAGGGPDLIVDDGGDATLLIHEGVKAEEEYEKTGKLPDPASTDNAEFQIVLGLISDSIKVDPKKYSKMKERLVGVSEETTTGVKRLYQMQASGSLLFPAINVNDSVTKSKFDNLYGCRHSLPDGLMRATDVMLAGKAAVVCGYGDVGKGCAAALKTAGARVIVTEIDPICALQALMEGIPVLTLEDVVADADIFVTATGNKDIIKVDHMKKMKNNAIVCNIGHFDNEIDMLGLEAVPGIKRITIKPQTDRWVFPDTNKGIILLAEGRLINLGCATGHPSFVMSCSFTNQVIAQLELWNERLSGKYEKKVYVLPKHLDERVALLHLGKLGAKLTKLSLAQAEYISVPVEGPYKPPHYRY

SEQ ID NO: 14035 - protein, 485 aa, Taxus baccata
MALLVEKTVAGREYKVKDLSQADFGRMELDLAEVEMPGLMACRIEYGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFAKSGKLPDPTSTTNPEFQIVLGLIRDTLKEDPLKYHKMKDRLVGVSEETTTGVHRLYQMQANGSLLFPAINVNDSVTKSKFDNLYGCRHSLPDGLMRATDVMIAGKVAVVCGYGDVGKGCAAAMKAAGARVIVTEIDPICALQALMEGIPVLTLVDVLETADIFVTTTGNKDIIMVDHMRKMKNNAIVCNIGHFDNEIDVHGLETYPGVKKVTIKPQTDRWVFPETNNGIILLAEGRLMNLGCATGHPSFVMSCSFTNQVIAQLELWNERKTGKYEKKVYVLPKHLDEKVAALHLPKLGAKLTKLSADQAAYINVPVEGPYKPVHYRY

SEQ ID NO: 14036 - protein, 485 aa, Podocarpus macrophillus
MALLVEKTVAGREYKVKDMSQADFGRMEIDLAEVEMPGLMACRAEYGAVQPLKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYTKSGTLPDPSSTTNPEFQIVLGLIKESLKVDPTRYHKMKDRLVGVSEETTTGVHRLYQMQTNGSLLFPAINVNDSVTKSKFDNLYGCRHSLPDGLMRATDVMIAGKVAVVCGYGDVGKGCAAALKAAGARVIVTEIDPICALQALMEGIPVLTLEDVVGTADIFVTTTGNKDIIMADHMKKMKNNAIVCNIGHFDNEIDMHGLETYPGVKKITIKPQTDRWVFPESNNGIIVLAEGRLMNLGCATGHPSFVMSCSFTNQVIAQLELWNERKTGKYEKKVYVLPKHLDEKVAALHLPKLGAKLTKLSPDQAAYINVPVEGPYKPAHYRY

SEQ ID NO: 14037 - protein, 459 aa, Flaveria ramosissima
VELELAEVEMPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFEKTGKLPDPSSTDNAEFQIVLSIIKDGLQSDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLDDVVSEADIFVTTTGNKDIIMVSDMKKMKNNAIVCNIGHFDNEIDMLGLETYPGVKRITIKPQTDRWVFPETNTGIIVLAEGRLMNLGCATGHPSFVMSCSFTNQVIAQLELWKEKNSGKYKKEVYVLPKHLDEKVAALHLGKLGAKLTKLTKDQADYISVPVEGPYKPAHYRY

SEQ ID NO: 14038 - protein, 485 aa, Gnetum gnemon
MALSTEKTAGGREYKVKDMSQADFGRLELDLAEVEMPGLMACRSEYGPSQPLKGARITGSLHMTVQTGVLIETLTALGAEVRWCSCNIFSTQDHAAAAIARDSAAVFAWKGETLQEYWWCTERSLDWGPGGGPDLIVDDGGDATLLIHEAVKAEAEFAKSGALPDPASSSNPEFQIVLGLIRDSLKVDPTRYSRMKERLVGVSEETTTGVKRLYQMQANGSLLFPAINVNDSVTKSKFDNLYGCRHSLPDGLMRATDVMIAGKVAVVCGYGDVGKGCAAALKQAGARVIVTEIDPICALQALMEGLPVMTLEDVVSTADIFVTTTGNKDIIMVDQMRKMKNNAIVCNIGHFDNEIDIYGLENFPGVKRITIKPQTDRWVFPDTNSGIIVLAEGRLMNLGCATGHPSFVMSCSFTNQVIAQLELWNERKSGKYEKKVYVLPKHLDEKVAALHLPKLGAKLTKLSPEQAAYINVPVEGPYKPAQYRY

SEQ ID NO: 14039 - protein, 485 aa, Physcomitrella patens
MELSVEKTASGREYKVRDMSQADFGRLELDLAEVEMPGLMSCRTEFGAAQPFKGAKITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEDVYAKDGTLPDPESTTNAEFKIVLTILRDGMKENPNKYHKMAERLVGVSEETTTGVKRLYQMMDNGSLLFPAINVNDSVTKSKFDNLYGCRHSLPDGLMRATDVMIAGKVAVIFGYGDVGKGCASAMKAAGARVIVTEIDPICALQALMEGYQVLRLEDCVEYADIFCTTTGNKDIIMVSDMRKMKNNAIVCNIGHFDNEIDMEGLETYPGVKRITIKPQTDRWVFPDTKRGVIILAEGRLMNLGCATGHPSFVMSCSFTNQVIAQLELWNEKKSGKYEKKVYVLPKHLDEKVALLHLEKLGARLTKLSEDQASYINVPVGGPYKPAHYRY

SEQ ID NO: 14040 - protein, 485 aa, Physcomitrella patens
MELSVEKTASGREYKVRDMSQADFGRLELDLAEVEMPGLMSCRTEFGAAQPFKGAKITGSLHMTIQTAVLIETLTALGAEVRWCSCNIFSTQDHAAAAIARDSAAVFAWKGETLQEYWWCTERALDWGPDGGPDLIVDDGGDATLLIHEGVKAEDAYAKDGTLPDPESTTNAEFKIVLTILRDGMKENPQKYHKMAERLVGVSEETTTGVKRLYQMMDNGSLLFPAINVNDSVTKSKFDNLYGCRHSLPDGLMRATDVMIAGKVAVIFGYGDVGKGCASAMKAAGARVIVTEIDPICALQALMEGYQVLRLEDCVEYADIFCTTTGNKDIIMVSDMRKMKNNAIVCNIGHFDNEIDMEGLETFPGVKRITIKPQTDRWVFPDTKRGVIILAEGRLMNLGCATGHPSFVMSCSFTNQVIAQLELWNERTSGKYEKKVYVLPKHLDEKVALLHLEKLGARLTKLSDDQASYINVPVGGPYKPAHYRY

SEQ ID NO: 14041 - protein, 467 aa, Petunia hybrida
MALLVEKTTSGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEYAKNGTVPDPTSTDNVEFQLVLGIIKESLKTDPTKYTKMKERLVGVSEETTTGVKRLYQMQANGTLLFPAINVNDSVTKSKFDNLYGCRHSLPDGLMRATDVMIAGKVAVVAGYGDVGKGCAMSLKQAGARVIVTEIDPICALQALMEGLQVLTLEDVVADADIFVTTTGNKDIIMVDHMRKMKNNAIVCNIGHFDNEIDMLGLETFPGVKRITIKPQTDRWVFPDTNSGIIVLAEGRLMNLGCATGHPSFVMSCSFTNQVIAQLELWNEKSSGKYEKKVYVLPKHLDEKVAGLHLGKARSPAYQALQGSS

SEQ ID NO: 14042 - protein, 485 aa, Physcomitrella patens
MELSVEKTASGREYKVRDMSQADFGRLELDLAEVEMPGLMSCRTEFGAAQPFKGAKITGSLHMTIQTAVLIDTLTDLGAEVRWCSCNIFSTQDHAAAAIARDSAAVFAWKGETLQEYWWCTERALDWGPDGGPDLIVDDGGDATLLIHEGVKAEDVYAKDGTLPDPESTTNAEFKIVLTILRDGMKENPNKYHKMAERLVGVSEETTTGVKRLYQMMDNGSLLFPAINVNDSVTKSKFDNLYGCRHSLPDGLMRATDVMIAGKVAVIFGYGDVGKGCASAMKAAGARVIVTEIDPICALQALMEGYQVLRLEDCVEYADIFCTTTGNKDIIMVSDMRKMKNNAIVCNIGHFDNEIDMEGLETYPGVKRITIKPQTDRWVFPDTKRGVIILAEGRLMNLGCATGHPSFVMSCSFTNQVIAQLELWNEKKSGKYEKKVYVLPKHLDEKVALLHLEKLGARLTKLSEDQASYINVPVGGPYKPAHYRY

SEQ ID NO: 14043 - protein, 485 aa, Ceratodon purpureus
MELSVEKTASGREYKVRDMSQADFGRMELDLAEVEMPGLMSCRTEFGAAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEIAYAKDGTLPDPESTTNAEFKIVLTILRDGMKESPNKYHKMAERLVGVSEETTTGVKRLYQMMDNGSLLFPAINVNDSVTKSKFDNLYGCRHSLPDGLMRATDVMIAGKVAVIFGYGDVGKGCASAMKAAGARVIVTEIDPICALQALMEGYQILTLDDCVEYADIFCTTTGNKDIIMVKDMKKMKNNAIVCNIGHFDNEIDMEGLETYPGVKRITIKPQTDRWVFPDTGRGIIVLAEGRLMNLGCATGHPSFVMSCSFTNQVIAQLELWNERKSGKYENKVYVLPKHLDEKVALLHLEKLGARLTKLSDDQASYINVPVGGPYKPAHYRY

SEQ ID NO: 14044 - protein, 448 aa, Scabiosa columbaria
GLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFAKSGKFPDPTSTDNPEFQIVLTIIRDGLKTDPKKYHKMKERLVGVSEETTTGVKRLYQMQDNGTLLFPAINVNDSVTKSKFDNLYGCRHSLPDGLMRATDVMIAGKIAVICGYGDVGKGCASAMKQAGARVIVTEIDPICALQALMEGLQVLTLEDALAEADIFVTTTGNKDIIMVDHMRKMKNNAIVCNIGHFDNEIDMMGLENYPGVKRITIKPQTDRWVFPDTKSGILILAEGRLMNLGCATGHPSFVMSCSFTNQVIAQLELWNEKSSGKYEKKVYVLPKHLDEKVAALHLGKLGAKLTKLTKDQSDYISIPIEGPYKPAHYRY

SEQ ID NO: 14045 - protein, 487 aa, Zostera marina
MASTLSVSKTTSGREYKVKDMSQADFGRLEIDLAEIEMPGLMACRTEFGPSQPFKNARISGSLHMTIQTAVLVETLTALGAEVRWCSCNIFSTQDHAAAVIARDSAAVFAWKGETLQEYWWCTDRCLDWGEGGGPDLIVDDGGDATLLIHEGVKAEEEFEKSGKLPDPTSTDNVEFQIVLGLIKEGLKINPTKYRTMRDRLVGVSEETTTGVHRLYQMQLNGTLLFPAINVNDSVTKSKFDNLYGCRHSLPDGLMRATDVMIAGKTAVVCGYGDVGKGCAAALKQAGARVIVTEVDPICALQACMEGLQVLTLEDVLSEADIFVTTTGNKGIIMVDQMRKMKNNAIVCNIGHFDNEIDINGLETYPGVQRVTIKPQTDRWVFPETNTGIILLAEGRLMNLGCATGHPSFVMSCSFTNQVIAQLELWNERKSGKYEKKVYVLPKHLDEKVAALHLPKLGARLTKLSKEQADYISVPIEGPYKPAHYRY

SEQ ID NO: 14046 - protein, 450 aa, Tragopogon dubius
MPGLMSCRTEFGPSQPFKGARITGSLHMTIQTGVLIETLTALGAEVRWCSCNIFSTQDHAAAAIARDSAAVFAWKGETLQEYWWCTERALDWGPGGGPDLIVDDGGDATLLIHEGVKAEEEFAKTGKVPDPTSTDNAEFQIVLSIIKEGLSTDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLPLEDVVSEADIFVTTTGNKDIIMVSDMKKMKNNAIVCNIGHFDNEIDMLGLETYPGVKRITIKPQTDRWVFPETKTGIIVLAEGRLMNLGCATGHPSFVMSCSFTNQVIAQLELWKERSTGKYKKEVYVLPKHLDEKVAALHLGKLGAKLTKLTKDQADYISVPVEGPYKPAHYRY

SEQ ID NO: 14047 - protein, 485 aa, Theobroma cacao
MALTISRTPTGREYKVKDISQADFGRLEIELAEVEMPGLMACRAEFGPTQPLKDARITGSLHMTIQTAVLIETLTALGAQVRWCSCNIFSTQDHAAAAIARDSASVFAWKGETLEEYWWCTEKALEWGPGGGPDLIVDDGGDATLLIHEGVKAEEVYERSGKLPNPNETENAEFRIVLSIIKEGLLVDPKKYRRMRERLVGVSEETTTGVKRLYQMQANGTLLFPAINVNDSVTKSKFDNLYGCRHSLPDGLMRATDVMIAGKIAVVCGYGDVGKGCAAALKAAGARVIVTEIDPICALQALMEGIPVLTLEDVVAEADIFVTTTGNKDIIMVCHMKQMKNNAIVCNIGHFDNEIDMLGLETYPGIKRITIKPQTDRWVFPETNRGIIVLAEGRLMNLGCATGHPSFVMSCSFTNQVIAQLELWKERGTGKYEKKVYVLPKHLDEKVAALHLGKLGAKLTKLTPEQAAYISVPVEGPYKPPRYRY

SEQ ID NO: 14048 - protein, 437 aa, Cleome gynandra
MALLVEKTSTGREYKVKDMSQADFGRLEIELAEVEMPGLMACRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEVFEKTGQVPDPSSTDNPEFQIVLQIIKDGLQVDPKKYHKMKERLVGVSEETTTGVKRLYQMQANGTLLFPAINVNDSVTKSKFDNLYGCRHSLPDGLMRATDVMIAGKVGVVCGYGDVGKGCALALKAAGARVIVTEIDPICALQALMEGFQILTLEDVVSEADIFVTTTGNKDIIMVDHMRKMKNNAIVCNIGHFDNEIDMHGLETFPGVKRITIKPQTDRWVFPDTKTGIIVLAEGRLMNLGCATGHPSFVMSCSFTNQVIAQLELWKEKATGKYEKKVY

SEQ ID NO: 14049 - protein, 485 aa, Gossypium hirsutum
MALTVSRTATGREFKVKDIAQADFGRLEIELAEVEMPGLMACRAEFGPTQPLKEARITGSLHMTIQTAVLIETLTALGAEVRWCSCNIFSTQDDAAAAIARDSAAVFAWKGETLEEYWWCTEKALDWGPGSGPDLIVDDGGDATLLIHEGVKAEEEYERSGKLPNPNETENAEFQIVLSIIKEGLLIDPKRYTRMKDRLVGVSEETTTGVKRLYQMQANGTLLFPAINVNDSVTKSKFDNLYGCRHSLPDGLMRATDVMIAGKIAVVCGYGDVGKGCAAALKAAGARVIVTEIDPICALQALMEGIPVLTLEDMVAEADIFVTTTGNKDIIMVSHMKQMKNNAVVCNIGHFDNEIDMLGLETYPGIKRITIKPQTDRWIFPETNRGIIVLAEGRLMNLGCATGHPSFVMSCSFTNQVIAQLELWKERGSGKYEKKVYVLPKHLDEMVASLHLGKLGAKLTKLTPDQAAYISVPVEGPYKPPHYRY

SEQ ID NO: 14050 - protein, 465 aa, Pteridium aquilinum
QADFGRLEIELAEVEMPGLMSCRTEFGPSQPLKGTRITGSLHMTIQTAVLIETLTALGAEVRWCSCNIFSTQDHAAAAIARDSAAVFAWKGENLQEYWWCTERALDWGPGGGPDLIVDDGGDATLLIHEGVKAEEAYAKDGTLPDPSSTENPEFQIVLSILRDGMKADPKKYHKMKDRIVGVSEETTTGVHRLYQMQANGSLLFPAINVNDSVTKSKFDNLYGCRHSLPDGLMRATDVMLAGKVVVVCGYGDVGKGCAAAMKAAGSRVVVTEIDPICALQATMEGLPVLTLEDVLETADIFVTTTGNKDIIMVSHMRKMKNNAIVCNIGHFDNEIDMLGLETYPGVKKITIKPQTDRWVFPETNTGIIVLAEGRLMNLGCATGHPSFVMSCSFTNQVIAQLELWNERKSGKYGKEVYVLPKHLDEKVAALHLEKLGVKLTKLTDDQAKYINVPIEGPYKPAHYRY

SEQ ID NO: 14051 - protein, 425 aa, Brassica rapa
  misc_feature (265)..(265): Xaa can be any naturally occurring amino acid
MALIVEKTSSGREYKVKDMSQADFGRLELELAEVEMPGLMACRTEFGPAQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEIFEKTGQVPDPTSTDNPEFQIVLSIIKEGLQVDPKKYHKMKERLVGVSEETTTGVKRLYQMQESGALLFPAINVNDSVTKSKFDNLYGCRHSLPDGLMRATDVMIAGKVXVVCGYGDVGKGCAAAMKTAGARVIVTEIDPICALQAMMEGLQVLTLEDVVSEADIFVTTTGNKDIIMVDHMRKMKNNAIVCNIGHFDNEIDMLGLETFPGVKRITIKPQTDRWVFPDTRTGIIVLAEGRLMNLGCATGHPSFVMSCSFTNQVIAQLELWN

SEQ ID NO: 14052 - protein, 454 aa, Primula obconica
AEVEMPGLMSCRTEFGPSQPFKGARITGSLHMTIQTAVLIETLTALGAEVRWCSCNIFSTQDHAAAAIARDSAAVFAWKGETLAEYWWCTERALDWGEGGGPDLIVDDGGDATLLIHEGVKAEEEFEKNGTVPDPTSTDNAEFQIVLSIIKEGLKTDPKRYHKMKTRLVGVSEETTTGVKRLYQMQLNGTLLFPAINVNDSVTKSKFDNLYGCRHSLPDGLMRATDVMIAGKVAVVCGYGDVGKGCAAALKQAGARVIVTEIDPICALQATMEGLQVLTLEDVVSQADIFVTTTGNKDIIMVSDMRKMKNNAIVCNIGHFDNEIDMLGLETYPGVKRITIKPQTDRWLFPETNTGIIILAEGRLMNLGCATGHPSFVMSCSFTNQVIAQLELWKEKDTGKYKKEVYVLPKHLDEKVAALHLEKLGAKLTKLSKDQADYISVPVEGPYKPAAYRY

SEQ ID NO: 14053 - protein, 522 aa, Beta vulgaris
SDEALFFSCVVLNSFLSLSLAPSSSVLERERKRAKMATSLSVEKTTSGREYKVKDMSQADFGRLEIELAEVEMPGLVSCRTEFGPSQPFKGAKITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEEEFEKSGKIPDPTSTDNVEFQLVLGLIKESLKVDPKRYHKMKERLVGVSEETTTGVKRLYQMQANGTLLFPAINVNDSVTKSKFDNLYGCRHSLPDGLMRATDVMIAGKVGVVCGYGDVGKGCALALKAAGARVIVTEIDPICALQALMEGFQILTLEDVLAEGDIFVTTTGNKDIIMVDHMKKMKNNAIVCNIGHFDNEIDMHGLETYPGIKRITIKPQTDRFVFPETKSGVIILAEGRLMNLGCATGHPSFVMSCSFTNQVIAQLELWNEKASGKYEKKVYVLPKHLDEKVAALHLNKLGAKLTKLTKDQSDYLSIPVEGPYKPAHYRY

SEQ ID NO: 14054 - protein, 456 aa, Pteridium aquilinum
DLAEVEMPGLMSCRSEFGPSQPLKGARITGSLHMTIQTAVLIETLTALGAEVRWCSCNIFSTQDHAAAAIARDSASVFAWKGETLQEYWWCTERALDWGPGGGPDLIVDDGGDATLLIHEGVKAEAAYAKDGTLPDPTSTDNQEFQLVLSIILDGIKKDPKKYHKMKDRLVGVSEETTTGVHRLYQMQNSGTLLFPAINVNDSVTKSKFDNLYGCRHSLPDGLMRATDVMIAGKVAVVCGYGDVGKGCASAMKAAGARVVVTEIDPICALQASMEGLPVLTLEDVLETADIFVTTTGNKDIIMVSHMKKMKNNAIVCNIGHFDNEIDMHGLETYPGVKKITIKPQTDRWVFPETNSGIIVLAEGRLMNLGCATGHPSFVMSCSFTNQVIAQLELWNERKSGKYGKQVYVLPKHLDEKVALLHLAKLGVKLTKLSKEQAEYINVPVEGPYKPAHYRY

SEQ ID NO: 14055 - protein, 471 aa, Sequoia sempervirens
KVKDLSLADFGRMELQLSEVEMPGLMACRAEFGSVQPFKGARITGCLHMTIQTAVLIETLTALGAEVRWCSSNIFSTQDHAAAAIARDSASVFSWKEETLQEYWWCVDRALDWGPGGGPDLLVDDGADVTILIHEGVKAEEEFAKNGKIPDLASTTSPEFQIILGLIKDSLKEDPLKYHKIKDRLVGVSEETTTGIYRLHQIQATGSLLFPAIGVNDSVTKSKFDNLYGCRHSLVDGLMRATDVMIAGKVAVVCGYGDVGKGCAAALKSAGARVIVTEIDPICALQALMEGIPVLTLEDVVSTADIFVTTTGNRDIIMVDDMRKMKNNAIVCNIGHFDNEIDMHGLETYPGVKKITIKPQTDRWVFPETNSGIIVLAEGRLMNLGCATGHPSFVMSCSFTNQVIAQLELWNERKTGKYEKKVYVLPKHLDEKVAALHLPKLGARLTKLSPDQAAYINVPVEGPYKPVHYRY

SEQ ID NO: 14056 - protein, 408 aa, Brassica napus
MALLVEKTSSGREYKVKDMSQADFGRLEIELAEVEMPGLVSCRTEFGPSQPFKGARITGSLHMTVQTAVLIETLTALGAEVRWCSCNIFSTQDHAAAAIARDSAAVFAWKGETLQEYWWCTERALDWGPGGGPDLIVDDGGDATLLIHEGVKAEEIFAKTGQVPDPTSTDNPEFQIVLSIIKDGLQVDPKKYHKMKERLVGVSEETTTGVKRLYQMQETGALLFPAINVNDSVTKSKFDNLYGCRHSLPDGLMRATDVMIAGKVAVICGYGDVGKGCAAAMKTAGARVIVTEIDPICALQALMEGLQVLTLEDVVSEADIFCTTTGNKDIIMVDHMRKMKNNAIVCNIGHFDNEIDMLGLETFPGVKRITIKPQTDRWVFPDTKTGIIVLAEGRLMNVGVCYVDTQVS

SEQ ID NO: 14057 - protein, 446 aa, Curcuma longa
MACRSEYGPSQPFAGARISGSLHMTIQTAVLIETLTALGAEVRWCSCNIFSTQDHAAAAIARDSAAVFAWKGETLAEYWWCTERALDWGTGGGPDLIVDDGGDATLLIHEGVKAEEEYKKSGKLPDPASTDNAEFQIVLGIIRDGLKVDPKKYHKMKERLVGVSEETTTGVKRLYQMQDSGSLLFPAINVNDSVTKSKFDNLYGCRHSLPDGLMRATDVMIAGKVGVVCGYGDVGKGCAAALKQAGARVIVTEIDPICALQALMEGIPVLPLEDVVAEADIFVTTTGNKDIIMVDHMKKMKNNAIVCNIGHFDNEIDMHGLETYPGIKRITIKPQTDRWVFPETNSGIIVLAEGRLMNLGCATGHPSFVMSCSFTNQVIAQLELWKERKSGKYDRKVYVLPKHLDEKVAALHLGKLGAKLTKLTPEQAEYIHVAVEGPYKPAHYRY

SEQ ID NO: 14058 - protein, 423 aa, Artemisia annua
MSIQTGVLIETLTALGAEVRWCSCNIFSTQDHAAAAIARDSAAVFAWKGETLQEYWWCTERALDWGPGGGPDLIVDDGGDATLLIHEGVKAEEEFAKTGKVPDPSSTDNAEFQIVLSIIKEGLAVDPKKYHKMKERLVGVSEETTTGVKRLYQMQANGTLLFPAINVNDSVTKSKFDNLYGCRHSLPDGLMRATDVMIAGKVAVVCGYGDVGKGCAAAMKQAGARVIVTEIDPICALQATMEGLQVLTLEDVVSEADIFVTTTGNKDIIMVSDMVKMKNNAIVCNIGHFDNEIDMLGLETYPGVQRITIKPQTDRWVFPETKTGIIILAEGRLMNLGCATGHPSFVMSCSFTNQVIAQLELWNERNSGKYKKEVYVLPKHLDEKVAALHLGKLGAKLTKLSKDQADYISVPVEGPYKPLHYRY

SEQ ID NO: 14059 - protein, 381 aa, Arachis hypogaea
MLAKRVASSAARSLLTSSNSTFTRNIHASGGKKKIVGVFYKGNEYASMNPNFVGCVEGALGIREWLESQGHEYIVTDDKEGPDSVLEKHIPDLHVLISTPFHPAYVTAERIKKAKNLELLLTAGIGSDHIDLNAAAAAGLTVAEVTGSNVVSVAEDELLRILILLRNFLPGYQQAVTGDWNVAGIAYRAYDLEGKTIGTVGAGRIGKLLLQRLKPFNCNLLYHDRLKMDPELENQIGAKFEEDLDAMLPKCDVIVINMPLTDKTRGLFDKDRIAKCKKGVLIVNNARGAIMDTQAVADACSSGHIAGYSGDVWFPQPAPKDHPWRYMPNHAMTPHISGTTIDAQLRYAAGVKDMLDRHFRGEDFPEQNYIVKEGQLAPQYR

SEQ ID NO: 14060 - protein, 387 aa, Trigonella foenum-graecum
MAMKRAASTLITTSSKISSLSSSSSSIITRNLHASGGKKKIVGVFYKGNEYASLNPNFVGCVEGALGIREWLESQGHEYIVTDDKEGLNSELEKHIPDLNVLISTPFHPAYVTAERIKKAKNLELLLTAGIGSDHIDLNAAAAAGLTVAEVTGSNTVSVAEDELMRILILVRNFLPGYHQAVTGEWNVAGIAHRAYDLEGKTVGTVGAGRIGKLLLQRLKPFNCNLLYHDRLKIEPELEKEIGAKFEEDLDAMLPKCDIIVINTPLTDKTRGLFDKNRIAKLKKGVLIVNNARGAIMDTQAVADACSSGHIAGYSGDVWFPQPAPKDHPWRYMPNHAMTPHISGTTIDAQLRYAAGVKDMLERHFKGEDFPEQNYIVKQGELASQYR

SEQ ID NO: 14061 - protein, 385 aa, Aristolochia fimbriata
MAMKKAATAAIKSLRSASSVSASSIFTRQLHAATGSKKIVGVFYKANEYASMNPNFVGCAEGALGIRDWLESQGHQYIVTDDKEGPTCELEKHIPDLHVLITTPFHPAYVTAERIKKAKNLQLLLTAGIGSDHVDLQAAAEAGLTVAEVTGSNVVSVAEDELMRILILVRNFVPGYHQVISGDWNVAAIAHRAYDLEGKTVGTFGAGRIGRLLLQRLKPFNCNLLYHDRVRMESELENQLGAKFEEDIDKMLPKCDIIVINTPLTEKTRGMFDSARIAKLKKGVLIVNNARGAIMDAQAVADACASGHIAGYSGDVWNPQPAPKDHVWRHMPNHAMTPHISGTTIDAQLRYAAGVKDMLDKYFKGEDFPTQNYIVKEGKLASQYL

SEQ ID NO: 14062 - protein, 379 aa, Eucalyptus grandis
MAMKRAGVSAISALCSSPNLTRGVHSTAGSKKIVGVFYKANEYAELNPNFVGTVERGLGIRDWLESQGHQYIVTDDKEGPDCELEKHLSNLHVLITTPFHPAYVTAERIKKAKNLQLLLTAGIGSDHIDLKAAAEAGLTVAEVTGSNVVSVAEDELMRILILVRNFLPGYHQVINGDWNVAGIAHRAYDLEGKTVGTVGAGRIGRLLLQRLKPFNCNLLYHDRIKIDPELENQTGAKFEEDLDVMLPKCDIIVLNTPLTEKTRGMLDKERISKLKKGVLIVNNARGALVDTQAVADACASGQIGGYSGDVWFPQPAPKDHPWRYMPNQAMTPHISGTTIDAQLRYAAGTKDMLDRYFKGEEFPVQNYIVKEGVLAPQYQ

SEQ ID NO: 14063 - protein, 372 aa, Castanea mollissima
MAGAATSAIKSVLTRHLHASPGSKKIVGVFYKANEYAALNPNFVGCVEGAIGIRDWLESQGHQYIVTDDKEGPNSELEKHIPDLHVLITTPFHPAYVTAERIKKAKNLQLLLTAGIGSDHIDLPAAAAAGLTVAEVTGSNVVSVAEDELMRILILVRNFLPGYHQAISGEWNVAAIAHRAYDLEGKTVGTVGAGRIGKLLLQRLKPFNCNLLYHDRLKMDPELENQIGAKFEEDLDAMLPKCDIIVINTPLTDKTRGLFDKDRIAKCKKGVLIVNNARGAIMDTQAVADACSSGHVAGYSGDVWFPQPAPKDHPWRYMPNHAMTPHISGTTIDAQLRYAAGTKDMLERYFKGEEFPPQNYIVKEGKLASQYQ

SEQ ID NO: 14064 - protein, 372 aa, Quercus alba
MAGAATSAIKSVLTRHLHASPGSKKIVGVFYKANEYAALNPNFVGCVEGALGIRDWLESQGHQYIVTDDKEGPNSELEKHIPDLHVLITTPFHPAYVTAERIKKAKNLQLLLTAGIGSDHIDLPAAAAAGLTVAEVTGSNVVSVAEDELMRILILVRNFLPGYHQAISGEWNVAAISHRAYDLEGKTVGTVGAGRIGKLLLQRLKPFNCNLLYHDRLKMDPELENQIGAKFEEDLDAMLPKCDIIVINTPLTDKTRGLFDKDRIAKCKKGVLIVNNARGAIMDTQAVADACSSGHVAGYSGDVWFPQPAPKDHPWRYMPNHAMTPHISGTTIDAQLRYAAGTKDMLERYFKGEEFPSQNYIVKEGKLASQYQ

SEQ ID NO: 14065 - protein, 386 aa, Lotus japonicus
MAMKRAASSAVRSLLTAPTPNPSSSIFSRNLHASGGKKKIVGVFYKANEYAALNPNFVGCVEGALGIREWLEAQGHEYIVTDDKEGLDSELEKHIPDLHVLISTPFHPAYVTAERIKKAKNLELLLTAGIGSDHIDLNAAAAAGLTVAEVTGSNTVSVAEDELMRILILVRNFLPGYHQAITGEWNVAGIAHRAYDLEGKTIGTVGAGRIGKLLLQRLKPFNCNLLYHDRLKMEPELEKEIGAKFEEDLDAMLPKCDVIVINTPLTDKTRGLFDKNRIAKLKKGVLIVNNARGAIMDTQAVADACSSGHIAGYSGDVWFPQPAPKDHPWRYMPNHAMTPHISGTTIDAQLRYAAGVKDMLERHFKGEDFPEQNYIVKEGQLASQYR

SEQ ID NO: 14066 - protein, 389 aa, Trifolium pratense
MAMKRAASTLITTTSSTISSLSSSSASSIITRNLHASGGKKKIVGVFYKGNEYASSNPNFVGCVEGGLGIREWLESQGHEYIVTDDKEGLDSVLEKHIPDLHVLISTPFHPAYVTAERIKKAKNLELLLTAGIGSDHIDLNAAAAAGLTVAEVTGSNTVSVAEDELMRILILTRNFVPGYHQAITGDWNVAGIAHRAYDLEGKTVGTVGAGRIGKLLLQRLKPFNVNLLYHDRLKIEPELEKELGATYEEDLDAMLPKCDIIVINTPLTEKTRGLFDKNRIAKLKKGVLIVNNARGAIMDTQAVADACSSGHIAGYSGDVWFPQPAPKDHPWRYMPNHAMTPHISGTTIDAQLRYAAGVKDMLERHFKGEDFPEQNYIVKQGELASQYR

SEQ ID NO: 14067 - protein, 381 aa, Glycine max
MAMMKRAASSALRSLIASSSTFTRNLHASGEKKKIVGVFYKGNEYAKLNPNFVGCVEGALGIREWLESQGHQYIVTDDKEGPDSELEKHIPDAHVIISTPFHPAYVTAERIKKAKNLELLLTAGIGSDHVDLKAAAAAGLTVAEVTGSNVVSVAEDELMRILILMRNFLPGYHQAVNGEWNVAGIAHRAYDLEGKTVGTVGAGRIGKLLLQRLKPFSCNLLYFDRLRIDPELEKEIGAKFEEDLDAMLPKCDVIVINTPLTEQTRGLFDKNRIAKCKKGVLIVNNARGAIADTQAIADACSSGHVAGYSGDVWFPQPAPKDHPWRYMPNHAMTPHISGTTIDAQLRYAAGVKDMLDRHFKGEDFPEQNYIVKEGQLASQYR

SEQ ID NO: 14068 - protein, 383 aa, Aquilegia formosa
MAMKKAALSTVQSVLSSSSFSTRLVRHIHASPGSKKIVGVFYKANEYAAMNPNFVGCAEGALGIRNWLESQGHQYIVTDDKEGPNCELEKHIPDLHVLISTPFHPAYVTEERIKKAKNLQLLLTAGIGSDHIDLKAASDAGLTVAEVTGSNVVSVAEDELMRILILVRNFLPGYHQVASGDWNVAAISHRAYDLEGKTVGTIGAGRIGKLLLQRLKPFNCNLLYHDRLKMDPDMENQTGAKFEEDLDKMLPKCDVIVVNMPLTEKTKGMFNKEKIAKLKKGVLIVNNARGAIMDTQAVADACSSGHIAGYSGDVWYPQPAPKDHPWRGMPNQAMTPHTSGTTIDGQLRYAAGVKDMLDKYFRGQEFPAQNYIVKEGQIASQYR

SEQ ID NO: 14069 - protein, 386 aa, Medicago truncatula
MAMKRAASTLITASSKISSLSSPSSIITRDLHASGGKKKIVGVFYKGGEYASLNPNFVGCVEGALGIREWLESQGHEYIVTDDKEGLNSELEKHIPDLNVLISTPFHPAYVTAERIKKAKNLELLLTAGIGSDHIDLNAAAAAGLTVAEVTGSNTVSVAEDELMRILILVRNFLPGYHQAITGEWNVAGIAHRAYDLEGKTVGTVGAGRIGKLLLQRLKPFNCNLLYHDRLKMEPELEKEIGAQFEEDLDAMLPKCDIIVMNMPLTDKTRGLFDKNRIAKLKKGVLIVNNARGALMDTQAVADACSSGHVAGYSGDVWFPQPAPKDHPWRYMPNHAMTPHISGTTIDAQLRYAAGVKDMLEKHFKGEDFPEQNYIVKEGQLASQYR

SEQ ID NO: 14070 - protein, 381 aa, Glycine max
MAMMKRAASSSVRSLLSSSSTFTRNLHASGEKKKIVGVFYKGNEYAKLNPNFVGCVEGALGIREWLESQGHQYIVTDDKEGPDSELEKHIPDAHVIISTPFHPAYVTAERIKKAQKLELLLTAGIGSDHVDLKAAAAAGLTVAEVTGSNVVSVAEDELMRILILMRNFLPGYHQAVKGEWNVAGIAHRAYDLEGKTVGTVGAGRIGKLLLQRLKPFNCNLLYFDRLRIDPELEKEIGAKFEEDLDAMLPKCDVIVINTPLTEQTRGLFDKNRIAKCKKGVLIVNNARGAIADTQAIADACSSGHVAGYSGDVWFPQPAPKDHPWRYMPNHAMTPHISGTTIDAQLRYAAGVKDMLDRHFKGEDFPEQNYIVKEGQLASQYR

SEQ ID NO: 14071 - protein, 366 aa, Utricularia gibba
SASSSILTRRLHASPGPKKIVGVLYKANEYASTNPNFVACAENALGIRDWLESQGHQYIVTADKEGPHCELEKHIPDLHVLITTPFHPAYVTAERIEKAKNLQLVLTAGIGSDHVDLKAAAAAGLTVAEVTGSNTVSVAEDELMRILILVRNFLPGYHQVINGEWNVAAIAHRAYDLEGKTVGTVGAGRIGRLLMQRLKPFNCNVLYHDRIKIDPELESEIGAKYEEDLDAMLPKCDIVVINTPLTEKTKGMFDKERIAKLKKGVLIVNNARGAIMDTQAVVDACSSGHIAGYSGDVWFPQPAPKDHPWRYMPNQAMTPHISGTTIDAQLRYAAGVKEMLDRYFKGEDFPQHYYIVKDGELAAQYR

SEQ ID NO: 14072 - protein, 376 aa, Carthamus tinctorius
  misc_feature (266)..(267): Xaa can be any naturally occurring amino acid
  misc_feature (272)..(273): Xaa can be any naturally occurring amino acid
  misc_feature (290)..(290): Xaa can be any naturally occurring amino acid
  misc_feature (294)..(294): Xaa can be any naturally occurring amino acid
  misc_feature (298)..(298): Xaa can be any naturally occurring amino acid
  misc_feature (301)..(302): Xaa can be any naturally occurring amino acid
  misc_feature (304)..(305): Xaa can be any naturally occurring amino acid
MAMKRAAATAISSASILTRHLHASAEKKKIVGVFYKAHEYAEMNPNFLGCAENALGIRNWLESQGHEYVVTDDKEGPDCELEKHISDMHVLITTPFHPAYVTAERIKKAKNLQLLLTAGIGSDHVDLQAAAAAGLTVAEVTGSNVVSVAEDELMRILILVRNFLPGHHQVITGDWNVAGIAYRAYDLEGKTVGTVGCGRIGRLLLQRLKPFGCNLLYHDRIKMDPELENQIGASFEEDLDKMLPKCDIIVINTPLTEKTKGMFDKXXIAKLXXGVLIVNNARGAIMDTQXVVDXCSSXHIXXYXXDVWYPQPAPKDHPWRYMPNQAMTPHISGTTIDAQLRYAAGVKDMLENYFKGEDFPAQHYIVKEGELASQYR

SEQ ID NO: 14073 - protein, 380 aa, Amborella trichopoda
  misc_feature (300)..(300): Xaa can be any naturally occurring amino acid
MAISRAAASVIPALLSKGPAISRHLHASSGSKKIVGVFYKANEYASMNPNFLGCAENALGIKGWLESQGHQYIVTDDKEGPYCELEKHIPDLHVLISTPFHPAYVTAERIKKAKNLELLLTAGIGSDHIDLKAAAAAGLTVAEITGSNVVSVAEDELMRILILVRNFLPGYHQVIKGEWNVAAIAYRAYDLEGKTIGTVGAGRIGKLLLQRLKPFNCNLLYHDRIKMEHELEAQIGAQFEPDVDAMLPKCDVIVINTPLTEKTKGMFDKNRIAKLKKGVLIVNNARGAIMDTDAVAEACXNGHIGGYSGDVWNPQPAPKDHPWRYMPNHAMTPHISGTTIDGQIRYAAGVKDMLERYFKGEDFPPQNYIVKEGKLASQYV

SEQ ID NO: 14074 - protein, 334 aa, Euphorbia esula
  misc_feature (66)..(66): Xaa can be any naturally occurring amino acid
  misc_feature (71)..(71): Xaa can be any naturally occurring amino acid
MNPNFLGCAEAGLGIREWLESQGHQYIVTDDKEGPDCELEKHIDDLHVLITTPFHPAYVTAERIKXAKNLXLLLTAGIGSDHIDLNAAAAAGLTVAEVTGSNVVSVAEDELMRILILVRNFLPGYHQVISGDWNVAGIAYRAYDLEGKTVGTVGAGRIGKLLLQRLKPFNCNLLYHDRLKMDPELESQIGATFEEDLDAMLPKCDIVVINTPLTDKTKGMFNKEKIAKMKKGVLIVNNARGAIMDTQAVADGCSTGQIGGYRGDVWYPQPAPKDHPWRYMPNQAMTPHISGTTIDAQLRYAEGVKDMLARYFKGEEFPLQNYIVKEGKLASQYQ

SEQ ID NO: 14075 - protein, 92 aa, Phalaenopsis aphrodite
MLATVDILQATVVMCGIHSQLQKITHGDTCQPGHDSSCSGTTIDGQLRYAAGVKDMLDNTSRRRLSQQNYIVKEGNLQASTCESVILTLYSV

SEQ ID NO: 14076 - protein, 87 aa, Antirrhinum majus
MAMKRAAVTAVRALTSSAPSSVLTRGLHASPGSKKIVGVFYKANEYASMNPNFLGCVENSLGIRDWFYSEGHQYIVTPDKDAPGLRA

SEQ ID NO: 14077 - protein, 130 aa, Sarracenia psittacina
MAMKRVAATAIRAFASSGNSSSLILTRSLHASTGKKKIVGVFYKGGEYAALNPNFVGCVEGALGIRDWLESLGHEYIVTDDKDGPNSELEKLIPDMNILIPTPFHPAYVTAEESRRPKSRTGGHSRNWLG

SEQ ID NO: 14078 - protein, 381 aa, Vigna unguiculata
  misc_feature (204)..(204): Xaa can be any naturally occurring amino acid
  misc_feature (271)..(271): Xaa can be any naturally occurring amino acid
MAMKSAASSAVRSLLSSSSSTFSRNLHAQGERKKIVGVFYKGGEYAKSNPNFVGCVEGALGIREWLESKGHQYIVTDDKEGPNSELDKHLPDAHIIISTPFHPAYVTAERIKKAKNLELLLTAGIGSDHVDLNAAAAAGLTVAEVTGSNVVSVAEDELLRILVLVRNFLPGYHQAVNGEWNVAGIAHRAYDLEGKTIGTVGAGXIGKLLLQRLKPFNCNLLYYDRLRMNTELEKEIGAKFEEDLDAMLPKCDVIVINMPLTEQTRGLFDKXRIAKCKKGVVIVNNARGAIMDTQAIADACTSGHVAGYGGDVWPVQPAPKDHPWRFMPNHAMTPHISGTTIDAQLRYAAGVKDMLDRHFRGEDFPEQNYIVKEGQLASQYR

SEQ ID NO: 14079 - protein, 376 aa, Festuca arundinacea
  misc_feature (234)..(234): Xaa can be any naturally occurring amino acid
MAMWRAAARHLVDRALGSRAAHTSAGSKKIVGVFYKAGEHADKNPNFVGCVEGALGIRNWLESKGHHYIVTDDKEGPNSELEKHIEDMHVLITTPFHPAYVSAERIKKAKNLELLLTAGIGSDHIDLPAAAAAGLTVAEVTGSNTVSVAEDELMRILILVRNFLPGYQQVVQGEWDVAGIAHRAYDLEGKTVGTVGAGRIGRLLLQRLKPFNCNLLYHDRLQINPELEKEIGAXFEEDLDAMLPKCDVIVINTPLTEKTRGMFNKEKIAKMKKGVIVVNNARGGIMDAQAVADACSSGHIAGYGGDVWFPQPAPKDHPWRYMPNHAMTPHISGTTIDAQLRYAAGVKDMLDRYFKGEDFPAENYIVKEGELASQYK

SEQ ID NO: 14080 - protein, 223 aa, Flaveria ramosissima
MRILILVRNFLPGYHQVITGDWNVAGIAYRAYDLEGKTVGTVGCGRIGRLLLQRLKPFGCNLLYHDRIKMDPDMENQIGASFEEDLDKMLPKCDIVVINTPLTDKTKGMFDKERIAKMKKGVLIVNNARGAIMDTQAVADGCSSGDIAGYSGDVWFPQPAPKDHPWRYMPNQAMTPHISGTTIDAQLRYAAGVKGMLENYFKGEDFPAQHYIVKEGELASQYR

SEQ ID NO: 14081 - protein, 257 aa, Gossypium hirsutum
MSHFVLVHGMCHGAWCWYKIVSLLKSGGHRVTPLDLGACGINPKTITDLASLSDYAQPLMELMASLPEDEKVILVGHSYGGVFISLAMESFPKKVLAAVYVAALMPNHDYPIATGLMELLKRIMAEPLLDFQVWFDDGSESPPTRALFGPKYTETKVYHLSPKADIELGLTLMRQGKLFLKDLANESLLSKEKFGSIHRVYIVCKDDLLVEESMQKWYIENSPTEDVKFIAGADHMPMFSKPHELCKCLQEVAHQYN

SEQ ID NO: 14082 - protein, 558 aa, Gossypium hirsutum
MSIEPFNRLVKLAARAFYDNVTTKAENQPKMGRGDNKGIAVVVLDALTRRQWVREEDLAKELKLHSKQLRRTLRLFEEEKLITREYRKETAKGAKLYNAAVAATVDGQPSGKEGEEKVKLHTHSYCCLDYAQIYDVVRCRLHRMKKKLKDELEDKNTVQEYVCPGCSKRYNALDALRLISLEDESFHCERCNGELVAESDKLAAEEVGEGDDNARRRRRENLKDMLQKMEVQLKPLMEQLNRVKDMPIPEFGTLLSWETRVGAAGHALNGAGSNDPYKNSQGYGGTPMPFLGDTKVEVAFSGLDSKEDVKTESASTSLKVLPPWMIKQGMNLTKEQRGEVKQESKAEDSSSQPDFSDDKKSTIGNDDKKNVQEDDKKNIQDEYLKAYYAALYKKQQELEEAEKKKQQPADTSLETDLSDSTKRQVGMKVKREDNDEEDDDINWEVDPFSISGNTTNNYKVDDLNVEAEASAGDDEDDIDWEEGCSMALARVTCGVNAGLYYSYLHLFFQDLPPCNCFVGINFIYHHLILCKQLQWEAEIYFRGLKNGFSRTRIVQNCK

SEQ ID NO: 14083 - protein, 474 aa, Manihot esculenta
MSVEPFNRLVKLAARAFYDDITTKGDNQPKTGRSDNRGIAVVVLDALTRRQWVREEDLAKDLKLHSKQLRRTLRFFEEEKLITRDHRKETAKGAKIYSAAVAATAEGQRNAKEGEEKIKLHTHSYCCLDYAQIYDVVRYRLHRLRKKLKDELENKNTVQEYICPNCGRRYNALDALRLVSPDDEYFHCENCNGELVAESDKLAAQEGGDGDDNARRRRREKLKDMLQKMEVQLKPLMDQLNRVKDLAVPEFGSLQAWEARASVAGRAVNGDSSSNDPSKSSQGLGYGRTPMTFIGETKVEVAFSGIEGKEEDVKSQTGSSGLKVLPPWMIKQGMNLTKEQRGEVKQESKMDGISAAEFSHEKKSTSDDVDNKSLQDEYVKAYYAALLKKQQELEEAAKNQELLQVSNSNAVPESVSNRQVGMKSKREEDEGEDDVEWEEAPTGGNSGESYKVNDLNVEAEASGEEEDDIDWEEG

SEQ ID NO: 14084 - protein, 783 aa, Theobroma cacao
MAAETALRITGSSSTVCNLNGSQRRPTPLSSPTRFLGLPPRASSSSVSSSLSHFLGSVRIGSRLPISRHQQGKRRNFSVFAMAAEETKRAVPLKDYRNIGIMAHIDAGKTTTTERILYYTGRNYKIGEVHEGTATMDWMEQEQERGITITSAATTTFWKNHRINIIDTPGHVDFTLEVERALRVLDGAICLFDSVAGVEPQSETVWRQADKYGVPRICFVNKMDRLGANFFRTRDMIVTNLGAKPLVIQLPVGAEDNFQGVVDLVKMQAVLWSGEELGAKFVYDDIPANLQELAEEYRSQMIETLVELDDQAMENYLEGVEPDEETIKKLIRKGTIGSSFVPVLCGSAFKNKGVQPLLDAVMDYLPSPLDLPAMKGTDPENPEVTIERKASDDVPFSGLAFKIMTDPFVGSLTFVRVYAGKLSAGSYALNANKGKKERIGRLLEMHANSREDVKVAMAGDIVALAGLKDTITGETLCDPDHPIVLERMDFPDPVIKVAIEPKTKADVDKMATGLIKLAQEDPSFHFSRDEEINQTVIEGMGELHLEIIVDRLKREFKVEANVGAPQVNYRESISKVSEVKYVHKKQSGGQGQFADITVRFEPMEAGSGYEFKSEIKGGAVPKEYIPGVMKGLEECMNNGVLAGFPVVDVRAVLVDGSYHDVDSSVLAFQLAARGAFREGIRKAGPRMLEPIMKVEVVTPEEHLGDVIGDLNSRRGQINSFGDKPGGLKVVDALVPLAEMFQYVSTLRGMTKGRASYTMQLAKFDVVPQHIQNELASKGQEVAA

SEQ ID NO: 14085 - protein, 789 aa, Ricinus communis
MAAETVRLTGSASSSLSSVNGSPRRRTSSLSTPIRFLGLPPRASSISASSISSSLSHFMGSVRIGLQSTTKAISRQQQRRRNFSVFAMAADEAKRAIPLKDYRNIGIMAHIDAGKTTTTERVLYYTGRNYKIGEVHEGTATMDWMEQEQERGITITSAATTTFWNNHRINIIDTPGHVDFTLEVERALRVLDGAICLFDSVAGVEPQSETVWRQADKYGVPRICFVNKMDRLGANFFRTRDMIITNLGAKPLVIQIPVGAEDNFQGVVDLVKMKAILWSGEELGAKFAYDNIPADLQDLAEEYRAQLIETIVELDDDAMEKYLEGVEPDEETIKKLIRKGTIGSSFVPVLCGSAFKNKGVQPLLDAVVDYLPSPLDLPAMKGTDPENPEVTIERTASDDEPFAGLAFKIMSDPFVGSLTFVRVYGGKLTAGSYVLNANKGKKERIGRLLEMHANSREDVKVALAGDIVALAGLKDTITGETLCDPDNPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITMRFEPMEPGSGYEFKSEIKGGAVPREYIPGVMKGLEECMNNGVLAGFPVVDVRAVLVDGSYHDVDSSVLAFQLAARGAFRDGMKRAGPKMLEPIMKVEVVTPEEHLGDVIGDLNSRRGQINSFGDKPGGLKVVDALVPLAEMFQYVSTLRGMTKGRASYTMHLAKFDVVPQHIQNQLAAKEQEVAA

SEQ ID NO: 14086 - protein, 781 aa, Tripterygium wilfordii
MAAETFKVTGSGSTVCSFNGSQRRPIPLCPKFRFLGLSPRVSTRSSICSSRSHFFGSKGIGSKLPVLRQRSRGKFSVFAMATEESKRAVPLQDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQLPIGSEDRFQGVVDLVKMKAVIWSGEELGAKFSYEDIPADLQELAEDYRAQMIETIVEQDDGAMESYLEGVEPDEQTIKKLIRKGAIGSSFVPVLCGSAFKNKGVQPLLDAVVDYLPSPLDVPAMKGTDPENPEVTVERSADDDEPFAGLAFKIMNDPFVGSLTFVRVYAGKLSAGSYALNANKGKKERIGRLLEMHANSREDVKVALAGDIVALAGLKDTITGETLCDPEHPIVLERMDFPDPVIKVAIEPKTKADIDKMATGLIKLAQEDPSFHFSRDEEVNQTVIEGMGELHLEIIVDRLKREFKVEANVGAPQVNYRESISRVTEVKYVHKKQSGGQGQFADITVRFEPMESGGGYEFKSEIKGGAVPKEYIPGVMKGLEECMSNGVLAGFPVVDVRAVLVDGSYHDVDSSVLAFQLAARGAFREGIRKAGPKMLEPIMKVEVVTPEEHLGDVIGDLNSRRGQINSFGDKPGGLKVVDALVPLAEMFQYVSTLRGMTKGRASYTMQLAKFDVVPQHIQNQLASKEQEVAA

SEQ ID NO: 14087 - protein, 787 aa, Manihot esculenta
MAAETVRLTGSSLYSLCSFNGSPRGANSSSRPIRFLGLPPRASFSPSSISSSLSHFLGSMRFGSQSSKVYTSRQQQQRRNFSVFAMAADETKRAVPLKDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQLPVGSEDNFQGVIDIVKMKAILWSGEELGAKFEYADIPAELEELAQEYRALLIENIVELDDDVMEKYLEGVEPDEETIKQLIRKGTIASSFVPVLCGSAFKNKGVQPLLDAVVDYLPSPLDLPSMKGTDPEKPEVTVERTASDDEPFSGLAFKIMSDPFVGSLTFVRVYAGKLAAGSYVLNANKGKKERIGRLLEMHANSREDVKVALTGDIVALAGLKDTITGETLCDPDSPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADVTIRFEPMEAGSGYEFKSEIKGGAVPREYIPGVMKGLEECMNNGVLAGFPVVDVRAVLVDGSYHDVDSSVLAFQLAARGAFRDGIKKAAPKMLEPVMKVEVVTPEEHLGDVIGDLNSRRGQINSFGDKPGGLKVVDSLVPLAEMFQYVSTLRGMTKGRASYTMQLAKFDVVPQHIQNQLATKEQEVAA

SEQ ID NO: 14088 - protein, 780 aa, Glycine max
MAAESSLRVATPTICNLNGSQRRPTTLSPLRFMGFSPRPSHSLTSSSLSHFFGSTRINSNSSSISRQHAPRRNFSVFAMSGDDAKRSVPLKDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFYRTRDMIVTNLGAKPLVIQLPIGSEDNFKGVIDLVRNKAIVWSGEELGAKFDIVDVPEDLQEQAQEYRAQMIETIVEFDDQAMENYLEGIEPDEETIKKLIRKGTISASFVPVMCGSAFKNKGVQPLLDAVVDYLPSPLDLPAMKGSDPENPEETIERVASDDEPFAGLAFKIMSDPFVGSLTFVRVYAGKLSAGSYVLNANKGKKERIGRLLEMHANSREDVKVALAGDIIALAGLKDTITGETLCDPDNPIVLERMDFPDPVIKVAIEPKTKADVDKMATGLIKLAQEDPSFHFSRDEEINQTVIEGMGELHLEIIVDRLKREFKVEANVGAPQVNYRESISKTAEVKYVHKKQSGGQGQFADITVRFEPMDPGSGYEFKSEIKGGAVPKEYIPGVMKGLEECMSNGVLAGFPVVDVRAVLTDGSYHDVDSSVLAFQLAARGAFREGIRKAGPRMLEPIMKVEVVTPEEHLGDVIGDLNSRRGQINSFGDKPGGLKVVDALVPLAEMFQYVSTLRGMTKGRASYTMQLAMFDVVPQHIQNQLATKEQEVAA

SEQ ID NO: 14089 - protein, 787 aa, Cleome spinosa
MAADALRITRLSSGSVVCDLNGSQRRPVLLPLSHRARFLGLPPRASSSSISSLSSELLGSFRFGLGSANVSRHGQNSRRRQFSVFAMADEVKRTVPLNDYRNIGIMAHIDAGKTTTTERILYYTGRNYKIGEVHEGTATMDWMEQEQERGITITSAATTTYWDKHRINIIDTPGHVDFTLEVERALRVLDGAICLFDSVAGVEPQSETVWRQADKYGVPRICFVNKMDRLGANFFRTRDMIVTNLGAKPLVLQLPIGSEDSFKGVVDLVKMKAIVWSGEELGAKFAYEDIPEDLQDLSQEYRSQMIETIVELDDEAMENYLEGVEPDEETVKKLVRKGTISAKFVPVLCGSAFKNKGVQPLLDAVVDYLPSPIDLPAMKGSDPENPEATVERKADDDEPFSGLAFKIMSDPFVGSLTFVRIYSGKLAAGSYVLNANKGKKERIGRLLEMHANSREDVKVALTGDIVALAGLKDTITGETLSDPDSPVVLERMDFPDPVIKVAIEPKTKADIDKMATGLIKLAQEDPSFHFSRDEEINQTVIEGMGELHLEIIVDRLKREFKVEANVGAPQVNYRESISKVAEVKYVHKKQSGGQGQFADITVRFEPLEAGSGYEFKSEIKGGAVPKEYIPGVMKGLEECMSNGVLAGFPVVDVRAVLVDGSYHDVDSSVLAFQLAARGAFRDGVKKAGPRMLEPIMKVEVVTPEEHLGDVIGDLNSRRGQINSFGDKPGGLKVVDALVPLAEMFQYVSTLRGMTKGRASYTMQLAKFDVVPQHIQNQLASKDQEVAA

SEQ ID NO: 14090 - protein, 787 aa, Manihot esculenta
MAAETLRLTGSASYSLCTFNGSTRGANSSSTPIRFLGLPPRASVSPSISSSLSHFMGGMRFGSQLSKVSISCRQQQRRRNFSVFALAAEEAKRAVPLKDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIITNLGAKPLVLQIPVGSEDNFQGVVDLVKMKAIIWSGEELGAKFVYDDIPVDLEDLAQEYRALLIENIVELDDDAMEKYLEGVEPDEEIIKKLIRKGTIASSFVPVLCGSAFKNKGVQPLLDAVVDYLPSPLDLPAMKGTDPENPEVTIERTASDDEPFSGLAFKIMSDPFVGSLTFVRVYAGKLAAGSYVLNANKGKKERIGRLLEMHANSREDVKLALTGDIIALAGLKDTITGETLCDPDNPIVLERMDFPDPVIKVAIEPKTKADVDKMATGLIKLAQEDPSFHFSRDEEINQTVIEGMGELHLEIIVDRLKREFKVEANVGAPQVNYRESISKVSEVKYVHKKQSGGQGQFADITVRFEPMEPGSGYEFKSEIKGGAVPKEYIPGVMKGMEECMSNGVLAGYPVVDVRAVLVDGSYHDVDSSVLAFQLAARGAFREGMKRAGPKMLEPIMKVEVVTPEEHLGDVIGDLNSRRGQINSFGDKPGGLKVVDALVPLAEMFQYVSTLRGMTKGRASYTMQLAKFDVVPQHIQNQLASKEQEVAA

SEQ ID NO: 14091 - protein, 779 aa, Prunus persica
MATESVRVYSFSFNGSQTRPAIPLSPARFLGLRPRPSSSLTSSSLSHFFGNVRLSSSNSSKLSILRQQSRRNLSVVAMAADDGKRAVPLEDYRNIGIMAHIDAGKTTTTERILFYTGRNYKIGEVHEGTATMDWMEQEQERGITITSAATTTFWDKHRINIIDTPGHVDFTLEVERALRVLDGAICLFDSVAGVEPQSETVWRQADRYGVPRICFVNKMDRLGANFFRTRDMIVTNLGAKPLVLQIPVGAEDNFKGVIDLVKMRAILWSGEELGAKFVYEDIPSDLLELAQEYRSQMIETIVELDDEAMEGYLEGVEPDEETIKKLIRKGTISISFVPVLCGSAFKNKGVQPLLDAVVDYLPSPLDVPPMKGTDADNPEIIIERAASDDEPFAGLAFKIMSDPFVGSLTFVRIYAGKLAAGSYVLNANKGKKERIGRLLEMHANSREDVKVALAGDIVALAGLKDTITGETLSDPEHPIVLERMDFPDPVIKVAIEPKTKADVDKMGAGLVKLAQEDPSFHFSRDEEINQTVIEGMGELHLEIIVDRLKREFKVEANVGAPQVNYRESISRVAETRYVHKKQSGGQGQFADITVRFEPMEPGNGYEFKSEIKGGAVPREYIPGVMKGLEECMSNGVLAGFPVVDVRAVLVDGSYHDVDSSVLAFQLAARGAFREGIKKAAPKMLEPIMKVEVVTPEEHLGDVIGDLNSRRGQINSFNDKPGGLKVVDALVPLAEMFQYVSTLRGMTKGRASYTMQLAKFDVVPQHIQNQLAAKEEEVAA

SEQ ID NO: 14092 - protein, 782 aa, Populus trichocarpa
MAAETVRLTGSASGSSTPCNFNGSQRRPTHFLGLPSSRASISISSSLSHFLGSSARIASHSSKFSTSRQLRERRRNFSVFAMAADEAKRTVPLKDYRNIGIMAHIDAGKTTTTERILYYTGRNYKIGEVHEGTATMDWMEQEQERGITITSAATTTFWNKHRINIIDTPGHVDFTLEVERALRVLDSAICLFDSVAGVEPQSETVWRQADKYGVPRICFVNKMDRLGANFFRTRDMIVTNLGAKPLVIQIPIGSEDSFKGIVDLVKMKAIVWSGEELGAKFAYEDIPADLQELAQEYRAQMIETIVELDDEAMEGYLEGVEPEEETIKILIRKGTIASIFVPVLCGSAFKNKGVQPLLDAVIDYLPSPIDLPAMQGSDPENPEVTIERAATDDEPFAGLAFKIMTDSFVGSLTFVRVYSGKLSAGSYVMNANKGKKERIGRLLEMHANSREDVKVALTGDIVALAGLKDTITGETLCDPDNPIVLERMDFPDPVIKVAIEPKTKADVDKMTTGLVKLAQEDPSFHFSRDEEINQTVIEGMGELHLEIIVDRLKREFKVEANVGAPQVNYRESISKVAEVKYVHKKQSGGQGQFADITVRFEPMEAGTGYEFKSEIKGGAVPREYVPGVMKGLEECMSNGVLAGFPVVDVRAVLVDGSYHDVDSSVLAFQLAARGAFREGIKKAGPRMLEPIMKVEVVTPEEHLGDVIGDLNSRRGQINSFGDKPGGLKVVDSLVPLAEMFQYVSTLRGMTKGRASYTMQLAKFDVVPQHIQNQLAAKEEVAA

SEQ ID NO: 14093 - protein, 775 aa, Citrullus lanatus
MAAEAVRAASSVCNFNGSQRRPAKPLSRTHFLLRSSRPSRSQFFGTNLRLTSSASSKLCNSRQQNRRNLSVFAMAAEDGKRAVPLEDYRNIGIMAHIDAGKTTTTERILYYTGRNYKIGEVHEGAATMDWMEQEKERGITITSAATTTFWNKHRINIIDTPGHVDFTLEVERALRVLDGAICLFDSVAGVEPQSETVWRQADKYGVPRICFINKMDRLGANFFRTRDMIVTNLGAKPLVLQLPIGSEDNFKGVVDLVRMKAIVWSGEELGAKFQYEDIPEDLVDLAQDYRSQMIETVVELDDQAMENYLEGIEPDESTIKKLIRKGTISASFVPVMCGSAFKNKGVQPLLDAVVDYLPSPIDLPPMKGTDPENPELIVERAANDDEPFSGLAFKIMSDPFVGSLTFVRVYAGKLSAGSYVLNSNKGKKERIGRLLEMHANSREDVKVALAGDIVALAGLKDTITGETLCDPDHPIVLERMDFPDPVIKVAIEPKTKADVDKMATGLIKLAQEDPSFHFSRDEEINQTVIEGMGELHLEIIVDRLKREFKVEANVGAPQVNYRESISKVSEVKYVHKKQSGGQGQFADITVRFEPMEPGSGYEFKSEIKGGAVPKEYIPGVVKGLEECMSNGVLAGFPVVDVRAVLVDGTYHDVDSSVLAFQLAARGAFREGMRKAGPRMLEPIMKVEVVTPEEHLGDVIGDLNSRRGQINSFGDKPGGLKVVDALVPLAEMFQYVSTLRGMTKGRASYTMQLAKFDVVPQHIQNELAAKEQEVAA

SEQ ID NO: 14094 - protein, 787 aa, Cleome gynandra
MAADALRITGSSSGSVVCNLNGSQKRPVLLPLSHRARFLGLPPRSSPSSISSSGSELLGSFRFGLGSSNVYRHGQTSRRKQFSVFAMADEVKRTVPLKDYRNIGIMAHIDAGKTTTTERILYYTGRNYKIGEVHEGTATMDWMEQEQERGITITSAATTTYWDKHRINIIDTPGHVDFTLEVERALRVLDGAICLFDSVAGVEPQSETVWRQADKYGVPRICFVNKMDRLGANFFRTRDMIVTNLGAKPLVIQIPIGSEDNFKGVVDLVRMKAIVWSGEELGAKFAYEDIPEDLQDLAQEYRALMIETIVELDDEAMENYLEGVEPDEMTIKKLIRNGTISGKFVPVLCGSAFKNKGVQPLLDAVVDYLPSPMDLPAMKGSDPENPEAIIERNADDAEPFSGLAFKIMSDPFVGSLTFVRIYSGKLSAGSYVLNANKGKKERIGRLLEMHANSREDVKVALTGDIVALAGLKDTITGETLSDTDSPVVLERMDFPDPVIKVAIEPKTKADIDKMATGLIKLAQEDPSFHFSRDEEINQTIIEGMGELHLEIIVDRLKREFKVEANVGAPQVNYRESISKVAEVKYVHKKQSGGQGQFADVTIRFEPMEAGSGYEFKSEIKGGAVPKEYIPGVMKGLEECMSNGVLAGFPVVDVRAALVDGSYHDVDSSVLAFQLAARGAFREGIKKAGPRMLEPIMKVEVVTPEEHLGDVIGDLNSRRGQINSFGDKPGGLKVVDALVPLAEMFQYVSTLRGMTKGRASYTMQLSKFDVVPQHIQNQLSSKDQEVAA

SEQ ID NO: 14095 - protein, 796 aa, Cannabis sativa
MAAKSLRLSTTTASPSSSSSSLTNFTFNASQRRPATILSPQGFLGLRPRPSSSLTSSSLSHFFGNGRLSSKAVKLTGSTQQSRRRNLSVFAMAADASAEKRAVPLKDYRNIGIMAHIDAGKTTTTERVLFYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRMGANFFRTRDMIVTNLGAKPLVIQLPVGAEDKFKGVVDLVRMKAIIWSGEELGAKFEYTDIPEDLQELAQEYRSQMIENIVELDDSAMESYLEGEEPDEETIKKLIRKGTIGGSFVPVLCGSAFKNKGVQPLLDAVVDYLPSPLDVPPMKGTDPDNPEIIIERSANDDEPFSGLAFKIMTDPFVGTLTFVRIYAGKLSAGSYVMNANKGKKERIGRLLEMHANSREDVKVALAGDIVALAGLKDTITGETLCDPDNPIVLERMDFPDPVIKVAIEPKTKADIDKMATGLIKLAQEDPSFHFSRDEEINQTVIEGMGELHLEIIVDRLKREFKVEANVGAPQVNYRESISKVAEVKYIHKKQSGGQGQFADITVRFEPMEAGSGYEFKSEIKGGAVPKEYIPGVMKGLEECMNNGVLAGFPVVDVRAALVDGSYHDVDSSVLAFQLAARGAFREGMRKAGPKMLEPIMKVEVVTPEEHLGDVIGDLNSRRGQINSFGDKPGGLKVVDALVPLAEMFQYVSTLRGMTKGRASYTMQLAKFDVVPQHIQNELAAAKEQEVTA

SEQ ID NO: 14096 - protein, 777 aa, Quercus alba
MAAESVRVSASSACNFSFNGSQRRPTIPLSPARFLGLRPRRQSSSSSEFLATVRLNSISSKPSTSQSRRNFSVFAMATEESKRAVPLNDYRNIGIMAHIDAGKTTTTERILYYTGRNYKIGEVHDGTATMDWMEQEQERGITITSAATTTFWNKHRINIIDTPGHVDFTLEVERALRVLDGTICLFDSVAGVEPQSETVWRQADKYGVPRICFVNKMDRLGANFFRTRDMIVTNLGAKPLVIQIPIGSEDTFQGVVDLVKMKAIVWSGEELGAKFVYEDIPTDLQELAQEYRSQMIETIIDLDDQVMESYLEGVEPDEETIKKLIRKGTISSSFVPVLCGSAFKNKGVQPLLDAVVDYLPSPVDLPAMKGTDPENPELIIERAASDDEPFSGLAFKIMSDSFVGSLTFVRVYSGKLTAGSYVLNANKNKKERIGRLLEMHANSREDVKVALTGDIIALAGLKDTITGETLSDPENPIVLERMDFPDPVIKVAIEPKTKADVDKMATGLIKLAQEDPSFHFSRDEEINQTVIEGMGELHLEIIVDRLKREFKVEANVGAPQVNYRESISRISEVKYVHKKQSGGQGQFADITVRFEPMEAGSGYEFKSEIKGGAVPREYIPGVMKGLEECMSNGVLAGFPVVDVRAVLVDGSYHDVDSSVLAFQLAARGAFREGVRKAAPKMLEPIMKVEVVTPEEHLGDVIGDLNSRRGQINSFGDKPGGLKVVDALVPLAEMFQYVSTLRGMTKGRASYIMQLAKFDVVPQHIQNELSSAKEQVAA

SEQ ID NO: 14097 - protein, 777 aa, Citrus clementina
MAAERMITASCSSAVCNFNMNGSQRRPVPVPVTVPRSLGLLPSRASHFLGSVRVFSPRSTSKLSPRSRRQFSVFAVAAEESKRVIPLKDYRNIGIMAHIDAGKTTTTERVLFYTGRNYKIGEVHEGTATMDWMEQEQERGITITSAATTTYWNKHRINIIDTPGHVDFTLEVERALRVLDGAICLFDSVAGVEPQSETVWRQADKYGVPRICFVNKMDRLGANFFRTRDMIVTNLGAKPLVVQLPVGAEDNFKGVVDLVKMKAIIWSGEELGAKFAYEDIPANLQKMAQEYRSQMIETIVELDDEAMESYLEGNEPDEETIKKLIRKGTIAGSFVPVLCGSAFKNKGVQPLLDAVVDYLPSPLDLPAMKGTDPENPEATLERAASDDEPFAGLAFKIMSDPFVGSLTFVRVYAGKLSAGSYVLNANKGKKERIGRLLEMHANSREDVKVALAGDIIALAGLKDTITGETLCDADHPILLERMDFPDPVIKVAIEPKTKADIDKMANGLIKLAQEDPSFHFSRDEEINQTVIEGMGELHLEIIVDRLKREFKVEANVGAPQVNYRESISKVSEVKYVHKKQSGGQGQFADITVRFEPMEAGSGYEFKSEIKGGAVPKEYIPGVMKGLEECMSNGVLAGFPVVDVRAALVDGSYHDVDSSVLAFQLAARGAFREGMRKAGPKMLEPIMKVEVVTPEEHLGDVIGDLNSRRGQINSFGDKPGGLKVVDALVPLAEMFQYVSALRGMTKGRASYIMQLAKFDVVPQHIQNQLAAKEQEVAA

SEQ ID NO: 14098 - protein, 785 aa, Euphorbia peplus
MAAESVRLTASSSSSLCSINGSARRADSSSSPSIRFLGLPPRASVSSSPISSSLSHFYGTTRLKVFNLRPQKHTRRSFSVFAMAAEAEGKRTVPLSDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQIPIGAEDNFKGVVDLVKMKAILWSGEELGAKFEYGDIPEDLKEVAEEYQAKMVETIVELDDEAMENYLEGVEPDEETIKRLIRKGTIEGNFVPVLCGSAFKNKGVQPLLDAVIDYLPSPLDVPPMQGTDPENPELTIDRPASDSEPFSGLAFKIMSDPFVGSLTFVRIYSGKLSAGSYVLNANKGKKERIGRLLEMHANSREDVKVALAGDIVALAGLKDTITGETLSDPESPIVLERMDFPDPVIKVAIEPKTKADIDKMATGLIKLAQEDPSFHFSRDEETNQTVIEGMGELHLEIIVDRLKREFKVEANVGAPQVNYRESISKISEVKYVHKKQSGGQGQFADITMRFEPMDSGSGYEFKSEIKGGAVPREYIPGVMKGIEECMSNGVLAGFPVVDVRAVLTDGSYHDVDSSVLAFQLAARGAFREGIRKAAPKMLEPIMKVEVVTPEEHLGDVIGDLNSRRGQINSFGDKPGGLKVVDALVPLAEMFQYVSTLRGMTKGRASYTMQLAKFDVVPQHIQNQLAAKEMEVAA

SEQ ID NO: 14099 - protein, 779 aa, Malus domestica
MATESVRVYSFSFNGGSQTRPAMSPSPARFLGLRHRPSSSLTSSSLSHFFGNVRISSHSSRLSNLRQQSRRNLSVFAMAAEDGKRAVALEDYRNIGIMAHIDAGKTTTTERILFYTGRNYKIGEVHEGTATMDWMEQEQERGITITSAATTTFWDNHRINIIDTPGHVDFTLEVERALRVLDGAICLFDSVAGVEPQSETVWRQADRYGVPRICFVNKMDRLGANFFRTRDMIVTNLGAKPLVLQIPVGAEDNFKGVIDLVKMRAILWSGEELGAKFVYEEIPSHLLELAQEYRAEMIETIVELDDQAMEGYLEGVEPDEETIKKLIRKGTIAISFVPVLCGSAFKNKGVQPLLDAVVDYLPSPLDVPPMKGTDADNPEITIERAASDEEPFAGLAFKIMSDPFVGSLTFVRIYAGKLTAGSYVLNANKGKKERIGRLLEMHANSREDVKVALAGDIVALAGLKDTITGETLSDPDHPIVLERMDFPDPVIKVAIEPKTKADVDKMGAGLVKLAQEDPSFHFSRDEEINQTVIEGMGELHLEIIVDRLKREFKVEANVGAPQVNYRESISRTSEVRYVHKKQSGGQGQFADVTVRFEPMEAGGGYEFKSEIKGGAVPREYIPGVMKGLEECMSNGVLAGFPVVDVRAVLVDGSYHDVDSSVLAFQLAARGAFREGIKKAAPKMLEPIMKVEVVTPEEHLGDVIGDLNSRRGQINSFNDKPGGLKVVDSLVPLAEMFQYVSTLRGMTKGRASYTMQLAKFDVVPQHIQNQLAAKEEEVAA

SEQ ID NO: 14100 - protein, 777 aa, Citrus sinensis
MAAERMITASCSSAVCNFAMNGSQRRPVPVPVTVPRSLGLLPSPASHFLGSVCVFSPRSTSKLSPRSRRQFSVFAMAAEESKRVIPLKDYRNIGIMAHIDAGKTTTTERVLFYTGRNYKIGEVHEGTATMDWMEQEQERGITITSAATTTYWNKHRINIIDTPGHVDFTLEVERALRVLDGAICLFDSVAGVEPQSETVWRQADKYGVPRICFVNKMDRLGANFFRTRDMIVTNLGAKPLVVQLPVGAEDNFKGVVDLVKMKAIIWSGEELGAKFAYEDIPANLQKMAQEYRSQMIETIVELDDEAMESYLEGNEPDEETIKKLIRKGTIAGSFVPVLCGSAFKNKGVQPLLDAVVDYLPSPLDLPAMKGTDPENPEATLERAASDDEPFAGLAFKIMSDPFVGSLTFVRVYAGTLSAGSYVLNANKGKKERIGRLLEMHANSREDVKVALAGDIIALAGLKDTITGETLCDADHPILLERMDFPDPVIKVAIEPKTKADIDKMANGLIKLAQEDPSFHFSRDEEINQTVIEGMGELHLEIIVDRLKREFKVEANVGAPQVNYRESISKVSEVKYVHKKQSGGQGQFADITVRFEPMEAGSGYEFKSEIKGGAVPKEYIPGVMKGLEECMSNGVLAGFPVVDVRAALVDGSYHDVDSSVLAFQLAARGAFREGMRKAGPKMLEPIMKVEVVTPEEHLGDVIGDLNSRRGQINSFGDKPGGLKVVDALVPLAEMFQYVSALRGMTKGRASYIMQLAKFDVVPQHIQNQLAAKEQEVAA

SEQ ID NO: 14101 - protein, 779 aa, Eucalyptus grandis
MAAESVRLAGPSPVCSFGGAQRRPAALLPSPAPFLCLRPRASSVSASSSQFLAGLRFGSRRFSRPQRRGRREFSVLAMAGEDGKRTVPLKDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQLPIGSEDNFQGVVDLVSMKAIVWSGEELGAKFVYDDIPADLQELAQDYRSQMIEIIVELDDEAMENYLEGVEPDEDTIKKLIRKGTMSSNFVPVLCGSAFKNKGVQPLLDAVVDYLPSPLDVPPMKGSDPENPEATIDRAASDEEPFAGLAFKIMSDSFVGSLTFVRVYAGKLSAGSYVLNANKGKKERIGRLLEMHANSREDVKVALAGDIVALAGLKDTITGETLCDPDAPILLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPLESGSGYEFKSEIKGGAVPKEYIPGVMKGLEECMSNGILAGFPVVDVRAALVDGSYHDVDSSVLAFQLAARGAFREGMRKAGPKMLEPIMRVEVITPEDHLGDVIGDLNSRRGQINSFGDKPGGLKVVDALIPLAEMFQYVSTLRGMTKGRASYTMQLAKFDVVPQHIQNQLAAKEQEVAA

SEQ ID NO: 14102 - protein, 777 aa, Cucumis sativus
MAAESVRAASSVCNFNGSQRRPAAPTPLSRTQFLLRSSRPSRSHFFGTNLRLTSSPSSNLCISRQQSRPNLSVFAMAAEDGKRSVPLEDYRNIGIMAHIDAGKTTTTERILYYTGRNYKIGEVHEGAATMDWMEQEKERGITITSAATTTFWNKHRINIIDTPGHVDFTLEVERALRVLDGAICLFDSVAGVEPQSETVWRQADKYGVPRICFINKMDRLGANFFRTRDMIVTNLGAKPLVLQLPIGSEDNFKGVVDLVRMKAIVWSGEELGAKFQYEDIPEDLVDLAQDYRSQMIETVVELDDEAMENYLEGIEPDEATIKKLIRKGAISACFVPVLCGSAFKNKGVQPLLDAVVDYLPSPIDLPPMKGTDPENPELIVERVASDDEPFSGLAFKIMSDPFVGSLTFVRVYAGKLSAGSYVMNSNKGKKERIGRLLEMHANSREDVKVALAGDIVALAGLKDTITGETLCDPDHPIVLERMDFPDPVIKVAIEPKTKADVDKMATGLIKLAQEDPSFHFSRDEEINQTVIEGMGELHLEIIVDRLKREFKVEANVGAPQVNYRESISKISEVKYVHKKQSGGQGQFADITVRFEPMEAGSGYEFKSEIKGGAVPKEYIPGVVKGLEECMSNGVLAGFPVVDVRAVLVDGTYHDVDSSVLAFQLAARGAFREGMRKAGPRMLEPIMKVEVVTPEEHLGDVIGDLNSRRGQINSFGDKPGGLKVVDALVPLAEMFQYVSTLRGMTKGRASYTMQLAKFDVVPQHIQNELAAKEQEVAA

SEQ ID NO: 14103 - protein, 786 aa, Catharanthus roseus
MAAESVVRMSSASTASSLYNFNGGSSRRPLLINSLRRAAGKATSGRVRSVPSEFFGTLRLSSAQKVSNLNQKQRKVNNFTVFAMAAADEGKRTVPLNDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQIPIGSEDNFQGVVDLVKMKAIVWSGEELGAKFAYEDIPADLQELAEEYRAQMIETIVELDDEAMENYLEGTEPDEETIKKLIRKGTISGSFVPVLCGSAFKNKGVQPLLDAVVDYLPSPLDLPAINGTDPENPETTLEKPASDDEPFAGLAFKIMSDPFVGSLTFVRVYSGKLAAGSYVLNANKGKKERIGRLLEMHANSREDVKVALTGDIVALAGLKDTITGETLCDPESPVVLERMDFPDPVIKVAIEPKTKADVDKMANGLIKLAQEDPSFHFSRDEETNQTVIEGMGELHLDIIVDRLKREFKVEANVGAPQVNYRESISKIAEVKYVHKKQSGGQGQFADITVRFEPLEAGSGYEFKSEIKGGAVPKEYIPGVMKGLEECMSNGVLAGFPVVDVRAVLVDGSYHDVDSSVLAFQLAARGAFREGVRKAGPRMLEPIMKVEVVTPEEHLGDVIGDLNSRRGQINSFGDKPGGLKVVDALVPLAEMFQYVSTLRGMTKGRASYTMQLAKFDVVPQHIQNQLAAKEEAVAS

SEQ ID NO: 14104 - protein, 783 aa, Amsonia hubrichtii
MAAESVVRMSSASTASSPCNFNGSSRRPLLINSLRRCGKSSTGRVRSLTSEFFASLRLSSTRKLSTLNQKQRKHNNFTVFAMAAEEGKRAVPLKDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQIPIGSEDNFQGVVDLVKMKAIVWSGEELGAKFSYKDIPADLQELAQDYRAQMIETIVELDDEAMENYLEGVEPDEETMKKLIRKGAISSSFVPVLCGSAFKNKGVQPLLDAVVDYLPSPLDLPPIKGTDPENPEVTLERPANDDEPFAGLAFKIMSDSFVGSLTFVRVYAGKLTAGSYVLNANKGKKERIGRLLEMHANSREDVKVALTGDIVALAGLKDTITGETLCDPESPVVLERMDFPDPVIKVAIEPKTKADVDKMANGLIKLAQEDPSFHFSRDEETNQTVIEGMGELHLDIIVDRLKREFKVEANVGAPQVNYRESISKVAEVKYVHKKQSGGQGQFADITVRFEPMEAGSGYEFKSEIKGGAVPKEYIPGVMKGLEECMSNGVLAGFPVVDVRAVLVDGSYHDVDSSVLAFQLAARGAFREGIRKSGPRMLEPIMKVEVVTPEEHLGDVIGDLNSRRGQINSFGDKPGGLKVVDALVPLAEMFQYVSTLRGMTKGRASYVMQLAKFDVVPQHIQNQLSAKEEAVSA

SEQ ID NO: 14105 - protein, 783 aa, Eutrema halophilum
MAADALRISSSSSGSLVCNLNGSQRRPVLIPLSHRATFLGLPPRASSSSISSSLPHFLGKSRFGLGSSKLSHRRKQFSVFAVAEGEAKRAVPLKDYRNIGIMAHIDAGKTTTTERILYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVVDLVRMKAIVWSGEELGAKFSYEDIPEDLEDLAQDYRAQMMELIVDLDDEVMENYLEGVEPDEATVKRLVRKGTITGKFVPILCGSAFKNKGVQPLLDAVVDYLPSPVEVPPMNGTDPENPEISIERKPNDDEPFAGLAFKIMSDPFVGSLTFVRVYSGKLTAGSYVLNANKGKKERIGRLLEMHANSREDVKVALTGDIVALAGLKDTITGETLSDPENPVVLERMDFPDPVIKVAIEPKTKADIDKMATGLIKLAQEDPSFHFSRDEEMNQTVIEGMGELHLEIIVDRLKREFKVEANVGAPQVNYRESISKIAEVKYTHKKQSGGQGQFADITVRFEPMEAGSGYEFKSEIKGGAVPREYIPGVMKGLEECMSSGVLAGFPVVDVRACLVDGSYHDVDSSVLAFQLAARGAFREGMRKAGPRMLEPIMRVEVVTPEEHLGDVIGDLNSRRGQINSFGDKPGGLKVVDSLVPLAEMFQYVSTLRGMTKGRASYTMQLAKFDVVPQHIQNQLSSKDQEVAA

SEQ ID NO: 14106 - protein, 775 aa, Brassica napus
MAADALRISSSSSLVCNLNGSQRRPVLTPLSHHRSTFLGLPPRASLSHLLGKARIGLDSSKLSHRRKQFSVFAAAEGEGKRAVPLKDYRNIGIMAHIDAGKTTTTERILYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGAKPLVLQIPIGAEDSFKGVVDLVRMKAIVWSGEELGAKFNYEDIPADLEELAQEYRAAMMELIVDLDDEVMENYLEGVEPDEATVKRLVRKGTITGKFVPILCGSAFKNKGVQPLLDAVVDYLPSPVEVPPMNGTDPENPEVTIVRKPDDEEPFAGLAFKIMSDPFVGSLTFVRVYSGKLTAGSYVLNANKGKKERIGRLLEMHANSREDVKVALTGDIVALAGLKDTITGETLSDPESPVVLERMDFPDPVIKVAIEPKTKADIDKMATGLIKLAQEDPSFHFSRDEEMNQTVIEGMGELHLEIIVDRLKREFKVEANVGAPQVNYRESISKVAEVKYTHKKQSGGQGQFADITVRFEPLEAGSGYEFKSEIKGGAVPREYIPGVMKGLEECMGSGVLAGFPVVDVRACLVDGSYHDVDSSVLAFQLAARGAFREGMRKAGPRMLEPIMRVEVVTPEEHLGDVIGDLNSRRGQINSFGDKPGGLKVVDSLVPLAEMFQYVSTLRGMTKGRASYTMQLAKFDVVPQHIQNQLSSKDQEVAA

SEQ ID NO: 14107 - protein, 783 aa, Eutrema parvulum
MAADALRISSSSSGSLVCNLNGSQRRPTLIPLSHRATFLGLPTRASSSSISSSLPHFIGKARIGLGSSKLSHRRKQFSVFAVAEGEGKRAVPLKDYRNIGIMAHIDAGKTTTTERILYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGANPLVLQIPIGAEDVFKGVVDLVRMKAIVWSGEELGAKFSYEDIPEDLQDLAQEYRAAMMELIVDLDDEVMENYLEGVEPDEATVKRLVRKGTITGKFVPILCGSAFKNKGVQPLLDAVVDYLPSPVEVPPMNGTDPENPELIIVRKPDDEEPFAGLAFKIMSDPFVGSLTFVRVYSGKLTAGSYVLNANKGKKERIGRLLEMHANSREDVKVALTGDIVALAGLKDTITGETLSDPENPVVLERMDFPDPVIKVAIEPKTKADIDKMATGLIKLAQEDPSFHFSRDEEMNQTVIEGMGELHLEIIVDRLKREFKVEANVGAPQVNYRESISKIAEVKYTHKKQSGGQGQFADITVRFEPLEAGSGYEFKSEIKGGAVPREYIPGVMKGLEECMCSGVLAGFPVVDVRACLVDGNYHDVDSSVLAFQLAARGAFREGMRKAAPRMLEPIMRVEVVTPEEHLGDVIGDLNSRRGQINSFGDKPGGLKVVDSLVPLAEMFQYVSTLRGMTKGRASYTMQLDKFDVVPQHIQNQLSSKDQEVAA

SEQ ID NO: 14108 - protein, 779 aa, Medicago truncatula
MAAESFQVATSSLCSLNGSHRKPTLLSPLRFMGTCFRPVQSRSFSSSSLSQFFRTSPIKPTSPQLVRTRRNFSVFAMSTPDEAKRAVPLKDYRNIGIMAHIDAGKTTTTERILFYTGRNYKIGEVHEGTATMDWMEQEQERGITITSAATTTFWDNHRINIIDTPGHVDFTLEVERALRVLDGAICLFDSVAGVEPQSETVWRQADRYGVPRICFVNKMDRLGANFFRTRDMIVTNLGAKPLVLQLPIGAEDSFKGVIDLVRMKAIVWGGEELGAKFTYEDIPVDLLEQAQDYRSQMIETIVELDDEAMENYLEGVEPDEATIKKLIRKGSIAATFVPVMCGSAFKNKGVQPLLDAVVDYLPSPLDVPPMKGTDPENPEATIERIAGDDEPFSGLAFKIMSDSFVGSLTFVRVYSGKLTAGSYVLNSNKGKKERIGRLLEMHANSREDVKVALTGDIVALAGLKDTITGETLCDPESPVVLERMDFPDPVIKIAIEPKTKADIDKMAAGLVKLAQEDPSFHFSRDEEINQTVIEGMGELHLEIIVDRLKREYKVEANVGAPQVNYRESISKIHEARYVHKKQSGGQGQFADITVRFEPMEPGSGYEFKSEIKGGAVPKEYIPGVVKGLEECMSNGVLAGFPVVDVRAVLVDGSYHDVDSSVLAFQLAARGAFREGIRKAGPRMLEPIMKVEVVTPEEHLGDVIGDLNSRRGQINSFGDKPGGLKVVDSLVPLAEMFQYVSTLRGMTKGRASYSMQLAMFDVVPQHIQNQLATKVQEVSA

SEQ ID NO: 14109 - protein, 778 aa, Fragaria vesca
MAAESVRAVQSFSFNGSQTRPTIPLSPPRFLGLRPPRSSSSSLTSSSLSHFFGNLRLASNSSKTSTLGRRNLSVLAMAADDGKRAVPLEDYRNIGIMAHIDAGKTTTTERVLYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVSNLGAKPLVLQIPVGAEDNFKGVIDLVKMRAIIWSGEELGAKFTYEDIPSDLQELADEYRSLMIETIVELDDEAMEGYLEGVEPDEAAIKKLIRQGTISASFVPVLCGSAFKNKGVQPLLDAVVDYLPSPLDVPPMQGTDADNPEITIERAASDDEPFAGLAFKIMSDPFVGSLTFVRVYAGKLSAGSYVLNANKGKKERIGRLLEMHANSREDVKVALTGDIIALAGLKDTVTGETLSDPEHPIVLERMEFPDPVIKVAIEPKTKADVDKMGAGLVKLAQEDPSFHFSRDEEVNQTVIEGMGELHLEIIVDRLKREFKVEANVGAPQVNYRESISKVAEVKYVHKKQSGGQGQFADITVRFEPMEPGNGYEFKSEIKGGAVPREYIPGVMKGLEECMSNGVLAGFPVVDVRAVLTDGSYHDVDSSVLAFQLAARGAFREGMKRAGPKMLEPIMKVEVVTPEEHLGDVIGDLNSRRGQINSFSDKPGGLKVVDAEVPLAEMFQYVSTLRGMTKGRASYTMQLAKFDVVPQHIQNQLSAKEEEVTA

SEQ ID NO: 14110 - protein, 783 aa, Arabidopsis thaliana
MAADALRISSSSSGSLVCNLNGSQRRPVLLPLSHRATFLGLPPRASSSSISSSIPQFLGTSRIGLGSSKLSQKKKQFSVFAAAEAEAKRAVPLKDYRNIGIMAHIDAGKTTTTERILYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGAKPLVLQIPIGAEDVFKGVVDLVRMKAIVWSGEELGAKFSYEDIPEDLEDLAQEYRAAMMELIVDLDDEVMENYLEGVEPDEATVKRLVRKGTITGKFVPILCGSAFKNKGVQPLLDAVVDYLPSPVEVPPMNGTDPENPEITIIRKPDDDEPFAGLAFKIMSDPFVGSLTFVRVYSGKISAGSYVLNANKGKKERIGRLLEMHANSREDVKVALTGDIIALAGLKDTITGETLSDPENPVVLERMDFPDPVIKVAIEPKTKADIDKMATGLIKLAQEDPSFHFSRDEEMNQTVIEGMGELHLEIIVDRLKREFKVEANVGAPQVNYRESISKIAEVKYTHKKQSGGQGQFADITVRFEPLEAGSGYEFKSEIKGGAVPREYIPGVMKGLEECMSTGVLAGFPVVDVRACLVDGSYHDVDSSVLAFQLAARGAFREGMRKAGPRMLEPIMRVEVVTPEEHLGDVIGDLNSRRGQINSFGDKPGGLKVVDSLVPLAEMFQYVSTLRGMTKGRASYTMQLAKFDVVPQHIQNQLSSKDQEVAA

SEQ ID NO: 14111 - protein, 782 aa, Arabidopsis lyrata
MAADALRISSSTSGSLVCNLNGSQRRPVLLPLSHRPTFLGLPPRASSSSISSSIPQFLGTSRIGLGSSKLSHKKKFSVFAAAEGEAKRAVPLKDYRNIGIMAHIDAGKTTTTERILYYTGRNYKIGEVHEGTATMDWMEQEQERGITITSAATTTFWDKHRINIIDTPGHVDFTLEVERALRVLDGAICLFDSVAGVEPQSETVWRQADKYGVPRICFVNKMDRLGANFFRTRDMIVTNLGAKPLVLQIPIGAEDVFKGVVDLVRMKAIVWSGEELGAKFSYEDIPADLEDLAQEYRAAMMELIVDLDDEVMENYLEGVEPDEATVKRLVRKGTITGKFVPILCGSAFKNKGVQPLLDAVVDYLPSPVEVPPMNGTDPENPEVTIIRKPDDDEPFAGLAFKIMSDPFVGSLTFVRVYSGKISAGSYVLNANKGKKERIGRLLEMHANSREDVKVALTGDIIALAGLKDTITGETLSDPENPVVLERMDFPDPVIKVAIEPKTKADIDKMATGLIKLAQEDPSFHFSRDEEMNQTVIEGMGELHLEIIVDRLKREFKVEANVGAPQVNYRESISKIAEVKYTHKKQSGGQGQFADITVRFEPLEAGSGYEFKSEIKGGAVPREYIPGVMKGLEECMSSGVLAGYPVVDVRACLVDGSYHDVDSSVLAFQLAARGAFREGMRKAGPRMLEPIMRVEVVTPEEHLGDVIGDLNSRRGQINSFGDKPGGLKVVDSLVPLAEMFQYVSTLRGMTKGRASYTMQLAKFDVVPQHIQNKLSDKDQEVAA

SEQ ID NO: 14112 - protein, 777 aa, Lippia dulcis
MKMSSNASSTLCNLNGSSRRPLPPVSRSTRRRKSNSSATVRALSSSFLGSMRLSSAAANLSNLQQKQQRRNFSVFAMAADDKRTVPLKDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFYRTRDMIVTNLGAKPLVLQLPVGAEDTFKGVIDLVKMQAILWSGEELGAKFSYEEIPEDLLEFAQEYRAQMIENIVELDDAAMESYLEGIEPDEETIKKLIRQGTIASSFVPVLCGSAFKNKGVQPLLDAVVDYLPSPIELPAMKGTDPDDPELEIERKPSDEEPFSGLAFKIMSDSFVGSLTFVRVYSGKLEAGSYVLNSNKGKKERIGRLLEMHANSREDVKVALTGDIVALAGLKDTITGETLCDPENPVVLERMDFPDPVIKVAIEPKTKADADKMTVGLLKLAQEDPSFHFSRDEEVHQTVIEGMGELHLEIIVDRLKREFKVEANVGAPQVNYRESISKTTEIKYVHKKQSGGAGQFADVTIRFEPLEAGSGYEFKSEIKGGAVPKEYIPGVMKGLEESMCNGVLAGYPVVDVRAVLVDGSYHDVDSSVLAFQLAARGAFREGIRKAGPQMLEPIMKVEVVTPEEHLGDVIGDLNSRRGQINSFGDKPGGLKVVDALVPLAEMFQYVSSLRGMTKGRASYSMQLAKFDVVPQHIQNQLAAKEEAVTA

SEQ ID NO: 14113 - protein, 784 aa, Tabernaemontana elegans
MAAESVVRISSASTASSLCNFNGSSRRPLLINSLRRGGKSSTTGARSLTSEFFGSLRLSSTKKLSTLNQKQRKHNNNFTVFAMAAEEGKRKVPLIDYRNIGIMAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAQPLVIQIPIGSEDNFQGVVDLARMKAIVWSGEELGAKFSYEDIPADLQQLAQEYRAQMIETIVEMDDEAMENYLEGVEPDEETIKKLIRKGTISGSFVPVLCGSAFKNKGVQPLLDAVVDYLPSPIDLPPIKGSDPENPEVTLEKPADDDEPFAGLAFKIMGDPFVGSLTFVRIYSGKLSAGSYVLNANKGKKERIGRLLEMHANSREDIKVALTGDIVALAGLKDTITGETLCDPESPVVLERMDFPDPVIKVAIEAKTKADVDKMANGLIKLAQEDPSFHFSRDEETNQTVIEGMGELHLEIIVDRLKREFKVEANVGAPQVNYRESISKVAEVKYVHKKQSGGQGQFADITVRFEPMEAGSGYEFKSEIKGGAVPKEYIPGVMKGLEECMSNGVLAGFPVVDVRAVLVDGSYHDVDSSVLAFQLAARGAFREGIRKAGPRMLEPIMKVEVVTPEEHLGDVIGDLNSRRGQINSFGDKPGGLKVVDALVPLAEMFQYVSTLRGMTKGRASYTMHLAKFDVVPQHIQNELSAKEEAVST

SEQ ID NO: 14114 - protein, 781 aa, Aristolochia fimbriata
MAAESVRISAPSASGAALRNLGSSRRALPLPSNGFLGLRNYGRGFPHAARSELFGNVRLSSKSLLPTLQPRKGRLSVVAMAAEDGKREVPLKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQLPIGAEDNFKGVVDLVTMKAIVWSGEELGAKFVYEEIPEDLQDLAQEYRTQMIELLVEMDDEAMENYLEGVEPDEATIKKLIRMGTIAAKFVPVLCGSAFKNKGVQPLLDAVVDYLPSPLDVPPMNGTDPENPELVIERKASDDEPFSGLAFKIMSDPYVGSLTFVRVYAGKLSAGSYVLNANKGKKERIGRLLEMHANSREDVKVALTGDIIALAGLKDTITGETLCDPDHPVVLERMDFPDPVIKVAIEPKTKADVDKMAIGLIKLAQEDPSFHFSRDEEINQTVIEGMGELHLEIIVDRLKREFKVEANVGAPQVNYRESISRVSEVKYVHKKQSGGQGQFADITVRFEPMEAGSGYEFKSEIKGGAVPKEYIPGVMKGLEECMSNGILAGYPVVDVRAVLVDGSYHDVDSSVLAFQLAARGAFREGVRKAGPRMLEPIMKVEVVTPEEHLGDVIGDLNSRRGQINSFGDKPGGLKVVDALVPLAEMFQYVSTLRGMTKGRASYTMQLAKFDVVPQHIQNQLSSKEEAVAA

SEQ ID NO: 14115 - protein, 780 aa, Flaveria ramosissima
MAAEAVTAASLCNFSGNNGGSSARPPLRRYLLSPSASLRRHHHHQRSLTSSFFGTQRLNPTKLTSHVQKRNLSVVAMAASEDAKREVPLKDYRNIGIMAHIDAGKTTTTERVLYYTGRNYKIGEVHEGTATMDWMEQEQERGITITSAATTTFWNNHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFSYEDIPSDLQELSEEYRALMLETIVELDDAVMEGYLEGVEPDEETVKKLIRKGTIGGSFVPVLCGSAFKNKGVQPLLDAVVDYLPSPLDLPPMKGTDPENPEIEIDRVASDDEPFAGLAFKIMNDPFVGSLTFVRIYAGKLAAGSYVMNANKGKKERIGRLLEMHANSREDVKVALAGDIVALAGLKDTITGETLCDPEKPIVLERMDFPDPVIKVAIEPKTKADVDKMANGLIKLAQEDPSFHFSRDEEINQTVIEGMGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVAT

SEQ ID NO: 14116 - protein, 778 aa, Flaveria ramosissima
MAAEAVTAAYLCNFSGNNGGSAARRHLLSPSASLRRHHHHQQQRSLTSSFFGTQRLNPTKLTSRVQKRNLSVVAMAASEDAKREVPLKDYRNIGIMAHIDAGKTTTTERVLYYTGRNYKIGEVHEGTATMDWMEQEQERGITITSAATTTFWNNHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFSYEDIPSDLQELSEEYRALMLETIVELDDEVMEGYLEGVEPDEQTVKKLIRKGTIGGSFVPVLCGSAFKNKGVQPLLDAVIDYLPSPLDLPPMKGTDPENPEIEIDRVASDDAPFAGLAFKIMNDPFVGSLTFVRIYAGKLAAGSYVMNANKGKKERIGRLLEMHANSREDVKVALAGDIVALAGLKDTITGETLCDPEKPIVLERMDFPDPVIKVAIEPKTKADIDKMANGLIKLAQEDPSFHFSRDEEINQTVIEGMGELHLEIIVDRLKREFKVEANVGAPQVNYRESISKVSEVKYVHKKQSGGQGQFADITVRFEPLEAGSGYEFKSEIKGGAVPREYIPGVMKGLEESMTNGVLAGFPVVDLRAVLTDGSYHDVDSSVLAFQLAARGAFREGVRKAGPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVAT

SEQ ID NO: 14117 - protein, 782 aa, Ambrosia trifida
MAAEAVTMSSNAALCNFSGSNITTSLRRRYLLSPSTSLRPRHPTLTSSFFGTQRLLTPTNFNSNSTSLSQKRNLSVFAMAASEDVKREVPLKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFAYEDIPADLQELAEEYRALMLETIVELDDEVMEGYLEGVEPDEATVKRLIRKGTIGGSFVPVLCGSAFKNKGVQPLLDAVVDYLPSPLDLPPMKGTDPENPEIEIERVASDDEAFSGLAFKIMNDPFVGSLTFVRIYSGKLAAGSYVMNANKGKKERIGRLLEMHANSREDVKVALAGDIVALAGLKDTITGETLSDAEKPIVLERMDFPDPVIKVAIEPKTKADVDKMANGLIKLAQEDPSFHFSRDEEINQTVIEGMGELHLEIIVDRLKREFKVEANVGAPQVNYRESISRMAEVKYVHKKQSGGQGQFADITVRFEPLEAGSGYEFKSEIKGGAVPREYIPGVMKGLEESMSNGVLAGFPVVDLRAVLTDGSYHDVDSSVLAFQLAARGAFREGVRKAAPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVTA

SEQ ID NO: 14118 - protein, 787 aa, Solanum lycopersicum
MAAESVTRMSSAASSLCNFNGSKRPVPVSNRVTSSRRNRCVKLQSLASASMSEFFGSSRVFSVNGSRSLGLSQKTRKNGFSVIAMAAAEEEKRTVPLKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQIPIGAEDTFKGLVDLVMMKAIVWSGEELGAKFSYEDIPADLQELAEEYRALMIETVVELDDDVMEKYLEGVEPDEATIKQLIRKGTISGNFVPVLCGSAFKNKGVQPLLDAVVDYLPSPVDVPPMNGTDPDNPEVIIERAPSDDEPFTGLAFKIMNDPFVGSLTFVRVYSGKLSAGSYVLNANKGRKERIGRLLEMHANSREDVKTALTGDIVALAGLKDTITGETLSDPEKPVVLERMDFPDPVIKVAIEPKTKADIDKMAQGLIKLAQEDPSFHFSRDEEINQTVIEGMGELHLEIIVDRLKREFKVEANVGAPQVNYRESISRNSEVKYVHKKQSGGSGQFADITVRFEPMEAGGGYEFKSEIKGGAVPKEYIPGVMKGLEECMSNGVLAGFPVVDVRAVLVDGSYHDVDSSVLAFQLAARGAFREGMRKAGPQLLEPIMKVEVVTPEEHLGDVIGDLNSRRGQINSFGDKPGGLKVVDSLVPLAEMFNYVSTLRGMTKGRASYVMQLAKFDVVPQHIQNQLAKKEEAAAA

SEQ ID NO: 14119 - protein, 782 aa, Ambrosia trifida
MAAEAVTMSSNAALCNFSGSNITTSLRRRYILSPSTSLHPRHPTLTSSFFGTQRLLTPTKFNSNSTSLSQKRNLSVFAMAASEDVKREVPLKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFTYEDIPADLQELAEEYRALMLENIVELDDEVMEGYLEGVEPDEATVKRLIRKGTIGGSFVPVLCGSAFKNKGVQPLLDAVVDYLPSPLDLPPMKGTDPENPEVEIERVASDDEAFSGLAFKIMNDPFVGSLTFVRIYSGKLAAGSYVMNANKGKKERIGRLLEMHANSREDVKVALAGDIVALAGLKDTITGETLSDAEKPIVLERMDFPDPVIKVAIEPKTKADVDKMANGLIKLAQEDPSFHFSRDEEINQTVIEGMGELHLEIIVDRLKREFKVEANVGAPQVNYRESISRMAEVKYVHKKQSGGQGQFADITVRFEPLEAGSGYEFKSEIKGGAVPREYIPGVMKGLEESMSNGVLAGFPVVDLRAVLTDGSYHDVDSSVLAFQLAARGAFREGVRKAAPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVTA

SEQ ID NO: 14120 - protein, 771 aa, Ambrosia trifida
MSSNAALCNFSGSNITTSLRRRYLLSPSTSLRPRHPTLTSSFFGTQRLLTPTNSTSLSQKRNLSVFAMAASEDVKREVPFKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFAYEDIPADLQELAEEYRALMLETIVELDDEVMEGYLEGVEPDEATVKRLIRKGTIGGSFVPVLCGSAFKNKGVQPLLDAVVDYLPSPLDLPPMKGTDPENPEIEIERVASDDEAFSGLAFKIMNDPFVGSLTFVRIYSGKLAAGSYVMNANKGKKERIGRLLEMHANSREDVKVALAGDIVALAGLKDTITGETLSDAEKPIVLERMDFPDPVIKVAIEPKTKADVDKMANGLIKLAQEDPSFHFSRDEEINQTVIEGMGELHLEIIVDRLKREFKVEANVGAPQVNYRESISRMAEVKYVHKKQSGGQGQFADITVRFEPLEAGSGYEFKSEIKGGAVPREYIPGVMKGLEESMSNGVLAGFPVVDLRAVLTDGSYHDVDSSVLAFQLAARGAFREGVRKAAPKILEPIMRVEVVTPEDHLGDVIGDLNSRRGQINSFGDKPGGLKVVDSLVPLAEMFQYVSTLRGMTKGRASYTMQLAKFDVVPQHIQNQLSAAKEEAVTA

SEQ ID NO: 14121 - protein, 781 aa, Arnica chamissonis
MAAEAVTAASLCNFSGSNVGSSSRPPLRCFILSPSTSLRRHHLHQQRSLTSPFVGTQRLTPIKSTSHFQKRNLSVFAMAATEDSKREVPLKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVSNLGAKPLVLQLPIGAEDVFKGVIDIVKMKAIVWNGEELGAKFSYEDIPSDLQELSEEYRALMFETIVDLDDEVMEGYLEGVEPDEETVKRLIRKGTIGGSFVPVLCGSAFKNKGVQPLLDAVVDYLPSPIDLPPMKGTEPDNPEIEIERVASDDEPFSGLAFKIMNDPFVGSLTFVRIYAGKLAAGSYVLNANKGKKERIGRLLEMHANSREDVKVALAGDIVALAGLKDTVTGETLCDPEKPIVLERMDFPDPVIKVAIEPKTKADVDKMANGLIKLAQEDPSFHFSRDEEVNQTVIEGMGELHLEIIVDRLKREFKVEANVGAPQVNYRESISRVSEVKYVHKKQSGGQGQFADITVRFEPLEAGSGYEFKSEIKGGAVPREYIPGVIKGLEESMSNGVLAGYPVVDVRAVLTDGSYHDVDSSVLAFQLAARGAFREGVRKAAPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVTA

SEQ ID NO: 14122 - protein, 776 aa, Helianthus annuus
MAAEASLCNFSGTNVSSPPLRRYLLSPSSSFRCRHLRQQRNLTSSFFGTQRLNSTKFNSNSHFQKRNLSVFAMAASEDVKREVPLKDYRNTGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVLQLPIGAEDVFKGVIDLVRMKAIVWSGEELGAKFAYEDIPADLQELAEEYRALMLETIVELDDEVMEGYLEGVEPDEATVKRLVRKGTIGGSFVPVLCGSAFKNKGVQPLLDAVVDYLPSPLDLPPMKGTDPENPEIEIERLASDDEAFSGLAFKIMNDPFVGSLTFVRIYSGKLAAGSYVINANKGKKERIGRLLEMHANSREDVKVALAGDIVALAGLKDTITGETLSDPEKPIVLERMDFPDPVIKVAIEPKTKADVDKMANGLIKLAQEDPSFHFSRDEEINQTVIEGMGELHLEIIVDRLKREFKVEANVGAPQVNYRESISRTAEVKYVHKKQSGGQGQFADITVRFEPLEAGSGYEFKSEIKGGAVPREYIPGVMKGLEESMSNGVLAGFPVVDLRAVLTDGSYHDVDSSVLAFQLAARGAFRDGVRKAAPKILEPIMSVEVVTPEEHLGDVIGDLNSRRGQINSFGDKPGGLKVVDALVPLAEMFQYVSTLRGMTKGRASYTMQLAKFDVVPQHIQNQLSAAKEEAVTA

SEQ ID NO: 14123 - protein, 784 aa, Triphysaria pusilla
MAAASAEAMMKISSNALCNLNGSSRRPLPPTSQSLRRRKSNYSSRTVRALSSSFLGSLGFASTSTRLSILQNQQKRRNFSVFAMAGDDKRTVPLKDYRNIGIMAHIDAGKTTTTERVLYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVSNLGAKPLVLQIPIGAEDTFKGVIDLVKMQAIIWSGEELGAKFSYEEIPEDLKELSEEYRAQMIENIVEQDDEAMEGYLEGIEPDEAMIKKLIRLGTIANSFVPVLCGSAFKNKGVQPLLDAVIDYLPSPLDVPPMKGTDPDDPELIIERKPSDDEPFSGLAFKIMSDSFVGSLTFVRVYSGKLGAGSYVINANKGKKERIGRLLEMHANSREDVKVALTGDIIALAGLKDTITGETLCDPENPVVLERMDFPDPVIKVAIEPKTKADIDKMAVGLIKLAQEDPSFHFSRDEEINQTVIEGMGELHLEIIVDRLKREYKVEANVGAPQVNYRESISKVTEVKYVHKKQSGGSGQFADITVRFEPLEAGSGYEFKSEIKGGSVPREYIPGVEKGLAESMPNGVLAGYPVVDVRAVLVDGSYHDVDSSVLAFQLAARGAFREGIRRAGPQMLEPIMKVEVVTPEDHLGDVIGDLNSRRGQINNFGDKPGGLKVVDAEVPLAEMFQYVSTLRGMTKGRASYTMQLAKFDVVPQHIQNKLADKGEAVTA

SEQ ID NO: 14124 - protein, 775 aa, Lactuca sativa
MAAESVAAASLCNFSGNNGSSSSRPLRRFFLSPATSLRRRSLTSSFFGTQRLTTNISTSHFQKKNLSVFAMAAGPEDGKRGVPLKDYRNIGIMAHIDAGKTTTTERVLYYTGRNYKIGEVHEGTATMDWMEQEQERGITITSAATTTFWNNHRINIIDTPGHVDFTLEVERALRVLDGAICLFDSVAGVEPQSETVWRQADKYGVPRICFVNKMDRLGANFFRTRDMIISNLGAKPLVLQLPIGAEDVFKGVIDLVRMKAIVWGGEELGAKFSYEDIPSDLQELSEEYRALLVENIVELDDVVMEAYLEGVEPDEDTIKKLIRKGTIGGSFVPVLCGSAFKNKGVQPLLDAVVDYLPSPLDVPPMKGTDPENPEIEIERIANDNEPFAGLAFKIMNDPFVGSLTFVRVYAGKLAAGSYVMNANKGKKERIGRLLEMHANSREDVKVALTGDIVALAGLKDTITGETLCDPEKPIVLERMDFPDPVIKVAIEPKTKADVDKMANGLIKLAQEDPSFHFSRDEEINQTVIEGMGELHLEIIVDRLKREFKVEANVGAPQVNYRESISRVSEVKYVHKKQSGGQGQFADITVRFEPLEAGTGYEFKSEIKGGAVPREYIPGVIKGLEESMSNGVVAGYPVVDLRAVLTDGSYHDVDSSVLAFQLAARGAFREGVRKAAPKILEPIMRVEVVTPEEHLGDVIGDLNSRRGQINSFGDKPGGLKVVDSLVPLAEMFQYVSTLRGMTKGRASYTMQLAKFDVVPQHIQNQLSAAKEEAVAA

SEQ ID NO: 14125 - protein, 778 aa, Aquilegia formosa
MASESLRISVSGSTFCNFHGSRRPHSVQAHQFHGFNNFNRSSFVSEFLGNVQLSSKSSSKVSLSQGEKKRLSVVAMAAPEEVKRAIPLKDYRNIGIMAHIDAGKTTTTERVLYYTGRNYKIGEVHEGTATMDWMEQEQERGITITSAATTTFWNNHRINIIDTPGHVDFTLEVERALRVLDGAICLFDSVAGVEPQSETVWRQADRYGVPRICFVNKMDRLGANFFRTRDMIVTNLGAKPLVLQIPVGAEDTFRGVVDLVRMKAILWSGEELGAKFVYEDIPDDLKDLADDYRTRLMELIIDLDDKVMEDYLEGVEPDEQTIKKLVRKGSIGGSFVPVLCGSAFKNKGVQPLLDAVVDYLPSPLDVPPMYGTDPEDPEVTIARAASDDEPFAGLAFKIMSDSFVGSLTFVRVYAGKLSAGSYVLNANKGKKERIGRLLEMHANSREDVKVALAGDIIALAGLKDTITGETLCDPEHPLVLERMDFPDPVIKVAIEPKTKADIDKMAVGLIKLAQEDPSFHFSRDEEINQTVIEGMGELHLEIIVDRLKREYKVEANVGAPQVNYRESISKVAEVKYVHKKQSGGAGQFADITVRFEPLKPGTGYEFKSEIKGGAVPKEYIPGVMKGLEECMSNGVLAGYPVVDVRACLVDGSYHDVDSSVLAFQLAARGAFREGMRRAGPRMLEPIMRVEVVTPDEHLGDVIGDLNSRRGQINNFGDKPGGLKVVDALVPLAEMFQYVSTLRGMTKGRASYSMQLANFDVVPQHIQNQLATKDQPVAA

SEQ ID NO: 14126 - protein, 682 aa, Vitis vinifera
MAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQLPIGAEDNFRGVIDLVKMQAVLWSGEELGAKFAYDDIPSDLLELAQDYRSQMIETIVELDDEAMEGYLEGVEPDEETIKKLIRKGTISASFVPVLCGSAFKNKGVQPLLDAVVDYLPSPLDLPAMKGTDPENPEVTVERAASDEEPFAGLAFKIMSDPFVGSLTFVRVYAGKLAAGSYVLNANKGKKERIGRLLEMHANSREDVKVALAGDIVALAGLKDTITGETLCDPENPIVLERMDFPDPVIKVAIEPKTKADVDKMASGLVKLAQEDPSFHFSRDEEINQTVIEGMGELHLEIIVDRLKREFKVEANVGAPQVNYRESISKVSEVKYVHKKQSGGQGQFADITVRFEPIEAGSGYEFKSEIKGGAVPKEYIPGVMKGLEECMSNGVLAGFPVVDVRAVLVDGSYHDVDSSVLAFQLAARGAFREGMRKAAPKMLEPIMKVEVVTPEEHLGDVIGDLNSRRGQINSFGDKPGGLKVVDALVPLAEMFQYVSTLRGMTKGRASYTMQLAKFEVVPQHIQNELAAKEQAVAA

SEQ ID NO: 14127 - protein, 775 aa, Sorghum bicolor
MAAEVPVRAPAAAARSARSRPAAAAAVVSASSASRLLLGYRPFHAPRFAAGRAAVAGPVAGLRPRSRRPRLSVVAMAGSDRQVPLHDYRNIGIMAHIDAGKTTTTERILYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVIDLVRMKAIVWTGEELGAKFEYKDIPDDLQELAQDYRVQMLETIIELDDEVMENYLEGTEPDEETVKKLIRKGTISASFVPVLCGSAFKNKGVQPLLDAVVDYLPSPLDLPSMKGTDPEDPEIIFERQPSDDEPFSGLAFKIMTDPFVGSLTFVRIYSGKLVAGSYVLNANKDKKERIGRLLEMHANSKEDIPVAVTGDIVALAGLKDTITGETLCDPDKPVVLERMEFPDPVIKVAIEPKTKADADKMANGLIKLAQEDPSFHFSRDEETNQTVIEGMGELHLDIIVDRLKREFKVEANVGAPQVNYRESISKVAEIQYVHKKQSGGSGQFADIIVRFEPLEAGSGYEFKSEIKGGAVPKEYVPGVMKGLEESLPNGVLAGYPVVDFRAVLVDGSYHDVDSSVLAFQIAARGAFREGMRKAGPRLLEPIMRVEVITPEEHLGDVIGDLNSRRGQVNSFGDKPGGLKVVDAFVPLAEMFQYVSTLRGMTKGRASYTMQLAKFDVVPQHIQNQLSTKTEEATA

SEQ ID NO: 14128 - protein, 777 aa, Phalaenopsis aphrodite
MACETIKVTASPSSCSLHGSLRRLSLASRRSLAHNSILAPGLRRTAVSDLFGGLRLRSGTTVHLSQGRKEKFLVMAAAEDDSKRKVPLKDYRNIGIMAHIDAGKTTTTERILYYTGRNYKIGEVHEGTATMDWMEQEQERGITITSAATTTFWNNHRINIIDTPGHVDFTLEVERALRVLDGAICLFDSVAGVEPQSETVWRQADKYGVPRICFVNKMDRLGANFFRTCEMIVTNLGAKPLVLQLPIGAEDSFSGVVDVVKMKSIIWTGEELGAKFSYERIPEDLQELAENYRTQLMETIVELDDKAMENYLEGIEPNEQTMKSLIRKGTISGAFVPVLCGSAFKNKGVQPLLDAVVDYLPSPIDLPPLKGSDPEDPERVLERFPSDDDPFAGLAFKIMNDPFVGSLTFVRVYSGKLSAGSYALNSNKGKKERIGRLLEMHANSREDVKSALTGDIVALAGLKETVTGETLCNPDKPIVLERMDFPDPVIKVAIEPKTKADLDKMAVGLIKLAQEDPSFHFSRDEETNQTVIEGMGELHLEIIVDRLKREFKVEANVGAPQVNYRESISRVSEVQYIHKKQSGGQGQFADITVRFEPLEPGSGYEFKSEIKGGAVPKEYIPGVMKGLEECMSNGVLAGYPVVDVRAVLVDGTYHDVDSSVLAFQLAARGAFREGMRKSAPKMLEPIMKVEVVTPEEHLGDVIGDLNSRRGQINNFGDKPGGLKVVDALVPLAEMFQYVSTLRGMTKGRASYTMQLANFDVVPQHIQNQLSSKEQVAV

SEQ ID NO: 14129 - protein, 771 aa, Panicum virgatum
MAAEAPVRAPAAARSARRPAAVVPTSSASRLLLGHRPFLAPRFAAGRAAVTGPAAGLRPHPRRPRLSVVAMAASDRQVPLQDYRNIGIMAHIDAGKTTTTERILYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVVQLPIGSEDNFQGVVDLVRMKAIVWTGEELGAKFDYQDIPADLQEMAQDYRVQMLETIIELDDDVMEKYLEGTEPDEETVKKLIRKGTISASFVPVLCGSAFKNKGVQPLLDAVVDYLPSPLDLPAMKGTDPEDPEVILERHPSDDEPFSGLAFKIMTDPFVGSLTFVRIYSGKLVAGSYVLNANKDKKERIGRLLEMHANSKEDITVAVTGDIVALAGLKDTITGETLCQEDKPVVLERMEFPDPVIKVAIEPKTKADADKMATGLIKLAQEDPSFHFSRDEETNQTVIEGMGELHLDIIVDRLKREFKVEANVGAPQVNYRESISKVAEVQYVHKKQSGGSGQFADIIVRFEPLEAGSGYEFKSEIKGGSVPKEYVPGVMKGLEESLPNGVLAGYPVVDFRAVLVDGSYHDVDSSVLAFQIAARGAFREGMRKAGPRLLEPIMRVEVITPEDHLGDVIGDLNSRRGQVNSFGDKPGGLKVVDAFVPLAEMFQYVSTLRGMTKGRASYTMQLAKFDVVPQHIQNQLSAAKTEEAAA

SEQ ID NO: 14130 - protein, 782 aa, Zostera marina
MAGDTLRLPVHPISGNFSRNRPQTPPLSVFSTRRGSFASRYGHSPAPRSDFFGNSCVRLKSVVPISRNGMRKVSPFVSMAAPEESKRVVALEDYRNIGIMAHIDAGKTTTTERVLFYTGRNYKIGEVHEGTATMDWMEQEQERGITITSAATTTFWDKHRINIIDTPGHVDFTLEVERALRVLDGAICLFDSVAGVEPQSETVWRQADRYGVPRICFVNKMDRLGANFFRTRDMIIENLGANPLVLQIPIGAEDTFKGIVDIVKMKAVVWSGEELGAKFAYEDIPSDLVDIAQEYRMSMLETIVELDDDVMEKYLEGIEPDEKTIKSIIRKGTISAKFVPVLCGSAFKNKGVQPLLDAVVDYLPSPIDVPPMKGTDPDDPEIIIERGANDEEPFSGLAFKIMGDTFVGSLTFVRVYSGKLTAGSYVLNANKGKKERIGRLLEMHANSREDVKTAVAGDIVALAGLKSTITGETLCDPDKPIVLERMDFPDPVIKVAIEPKTKADIDKMAVGLIKLAQEDPSFHFSRDEEINQTIIEGMGELHLEIIVDRLKREHKVEANVGAPQVNYRESISKISEVKYIHKKQSGGAGQFADITVRFEPMEPGSGYEFKSEIKGGAVPKEYIPGVIKGLEECMNNGVLAGYPVVDVCAALVDGNYHDVDSSVLAFQLAARGAFRDGMRKAGPRILEPIMRVEVITPEEHLGDVIGDLNSRRGHISTFGDKPGGLKVVDSLVPLAEMFQYVSTLRGMTKGRASYSMQLSKFDVVPQHIQNQIANKDEPVTAS

SEQ ID NO: 14131 - protein, 769 aa, Zea mays
MAAEAPVRAPATARSSRRPAAAVVSASRLLLGHRPFLAPRFAAGRAAVAGPAAGLRPRPRRPRLSVVVMASSDRQVPLHDYRNIGIMAHIDAGKTTTTERILYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVVDLVRMKAIVWTGEELGAKFEYKDIPADLQEMAQDYRVQMLETIIELDDEVMEKYLEGTEPDEETVKKLIRKGAISASFVPVLCGSAFKNKGVQPLLDAVVDYLPSPLDLPSMKGTDPEDPEIIFERQPSDDEPFSGLAFKIMTDPFVGSLTFVRIYSGKLIAGSYVLNANKDKKERIGRLLEMHANSKEDIPVAVTGDIVALAGLKDTITGETLCDPDKPVVLERMEFPDPVIKVAIEPKTKADADKMATGLIKLAQEDPSFHFSRDEETNQTVIEGMGELHLDIIVDRLKREFKVEANVGAPQVNYRESISKVAEIQYVHKKQSGGSGQFADIIVRFEPLEAGSGYEFKSEIKGGAVPKEYVPGVMKGLEESLPNGVLAGYPVVDFRAVLVDGSYHDVDSSVLAFQIAARGAFREGMRKAGPRLLEPIMKVEVITPEEHLGDVIGDLNSRRGQVNSFGDKPGGLKVVDSFVPLAEMFQYVSTLRGMTKGRASYTMQLAKFDVVPQHIQNQISVAKTEEAAA

SEQ ID NO: 14132 - protein, 773 aa, Setaria italica
MAAEAPVRAPAAAARSARRLAAAAVSASSASRLLLGHRPFLAPRFAAGRAAVAGPAAGLRPRPRKPRLSVVAMAGSDRQVPLEDYRNIGIMAHIDAGKTTTTERILYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVIQLPIGSEDSFQGVVDLVRMKAIVWTGEELGAKFEYQDIPANLQEMAEDYRVQMLETIIELDDEVMEKYLEGIEPDEETVKKLIRKGTISASFVPVLCGSAFKNKGVQPLLDAVVDYLPSPLDLPAMKGTDPDDPELVLERNPSDDEPFSGLAFKIMTDPFVGSLTFVRIYSGKLVAGSYVLNANKDKKERIGRLLEMHANSKEDITVAVTGDIVALAGLKDTITGETLCEPDKPVVLERMEFPDPVIKVAIEPKTKADADKMATGLIKLAQEDPSFHFSRDEETNQTVIEGMGELHLDIIVDRLKREFRVEANVGAPQVNYRESISKVAEVQYVHKKQSGGSGQFADIIVRFEPLEAGSGYEFKSEIKGGSVPKEYVPGVMKGLEESLPNGVLAGYPVVDFRAVLVDGSYHDVDSSVLAFQIAARGAFREGMRKAGPRLLEPIMRVEVVTPEDHLGDVIGDLNSRRGQVNSFGDKPGGLKVVDAFVPLAEMFQYVSTLRGMTKGRASYTMQLAKFDVVPQHIQNQLSAAKTEEAAA

SEQ ID NO: 14133 - protein, 782 aa, Distylium racemosum
MAETQSLAKCFTCSLQKSNGRHRHISRKSKNGFLLNSFHGVKSRGWFPSSSSSLQGLKFSQLLHKASVSTSPNVSGRLPIVCMAADGREVPLADYRNIGIMAHIDAGKTTTTERILYYTGKNYKIGEVHEGTATMDWMEQEQERGITITSAATTAVWNNHRINIIDTPGHVDFTLEVERALRVLDGTICLFDSVAGVEPQSETVWRQADKYGVPRICFVNKMDRLGANFFRTRDMIIANLGAKPLVVQIPIGAEDSFQGIVDLIKLKAVVWSGEELGAKFSYEDIPADLVDLAMEYRNQMIETIVELDDEAMEKYLEGEELDEKTIKKLIRKGTISIKFVPVLCGSAFKNKGVQPLLDAVVDYLPSPLDLPPIKGIDAENPEVTLERCPSDDEPFAGLAFKIMTDPFVGSLTFVRVYSGKLNAGTYVLNSNKGKKERIGRLLQMHANSRDDVKVAVTGDIVALAGLKDTITGETLCDPDNPIVLERMEFPDPVIKVAIEPKTKADVDKMSFGLVKLAQEDPSFHFSRDEETNQTVIEGMGELHLEIIVDRLKREFKVEANVGAPQVNYRESISRIAEVKYVHKKQSGGQGQFADVSVRFEPMEAGSGYEFKSEIKGGAVPKEYIPGVMKGLEECMSNGILAGYPVVDVRAVLTDGSYHEVDSSALAFQLAARGAFREGIRKAGPRLLEPIMKVEVVTPEEHLGDVIGDLNSRRGQIISFEDKPGGLKVIDSLVPLAEMFQYVSRLRGMTKGRASYTMQVAKFDVVPQHIQNQIATKSLEVAA

SEQ ID NO: 14134 - protein, 768 aa, Zea mays
MAAEAPVRAPAAARSARRPAAVVSASRLLLGYGPFLAPRFAAERAAVAGPAAGLCARPRKPRLSVVAMAGTDRQVPLHDYRNIGIMAHIDAGKTTTTERVLYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVVDLVRMKAIVWTGEELGAKFEYRDIPADLQEMAQDYHVQMLETIIELDDDVMEKYLEGTEPDEETVKKLIRKGTISASFVPVLCGSAFKNKGVQPLLDAVVDYLPSPLDLPPMKGTDPEDPEILLERQPSDDEPFSGLAFKIMTDPFVGSLTFVRIYSGKLIAGSYVLNANKDKKERIGRLLEMHANSKEDIPVAVTGDIVALAGLKDTITGETLCDPDKPVVLERMEFPDPVIKVAIEPKTKADADKMATGLIKLAQEDPSFHFSRDEETNQTVIEGMGELHLDIIVDRLKREFKVEANVGAPQVNYRESISKVAEIQYVHKKQSGGSGQFADILVRFEPLEAGSGYEFKSEIKGGAVPKEYVPGVMKGLEESLPNGVLAGYPVVDFRAVLVDGSYHDVDSSVLAFQIAARGAFREGMRKAGPRLLEPIMRVEVITPEEHLGDVIGDLNSRRGQVNSFGDKPGGLKVVDAFVPLAEMFQYVSTLRGMTKGRASYTMQLAKFDVVPQHIQNQLSTAKAEEAAA

SEQ ID NO: 14135 - protein, 785 aa, Cedrus atlantica
MAEALKLSPCFSYSLHNYSSRRKYSSRRSKEGISLNSFSGLKALDGFPLRSPSIQGFRPNDLLLRKASVSTSTSVRGRTSIVSMAADGPSRVVPLSDYRNIGIMAHIDAGKTTTTERVLYYTGKNYKIGEVHEGTATMDWMEQEQERGITITSAATTCAWNNHRINIIDTPGHVDFTLEVERALRVLDGSICLFDSVAGVEPQSETVWRQADRYGVPRICFVNKMDRLGANFFRTRDMIITNLGAKPLVLQIPIGAEDRFKGVVDLVKMKAVLWSGEELGATFSYEDIPADLLDLATEYRNQMIETIVELDDDAMENYLEGVEPDEKTIKRLIRKGTIAISFVPVLCGSAFKNKGVQPLLDAVVDYLPSPLDLPPMKGTDVDDPEVTLERLASDDEPFAALAFKIMTDPFVGSLTFVRIYSGVLTAGSYVLNSNKGKKERIGRLLQMHAISRDDVKIAVTGDIVALAGLKDTITGESLCDPDKPIVLERMNFPEPVIKVAIEPKTKADVDKMSMGLVKLAQEDPSFHFSRDEESNQTVIEGMGELHLEIIVDRLKREFKVEANVGAPQVNYRESISKTAETKYVHKKQSGGQGQFADVSVRFEPLEPGSGYEFKSEIKGGVVPKEYIPGVMKGLEECMSNGILAGYPVVDVRAVLTNGSYHEVDSSALAFQLAARGAFREGIRKAGPRLLEPIMKVEVVTPEEHLGDVIGDINSRRGQINTFDDKPGGLKVIDALVPLAEMFQYVSTLRSMTKGRASYTMQLAKFDVVPQHIQNQLSSKVQEVAA

SEQ ID NO: 14136 - protein, 788 aa, Cephalotaxus harringtonia
MAETLKLAKCFSCSSLQNNNSLGHKHNGSRRISKNGVVVNSFHKLKSLAGFPLPSSSLQGANLNISQLLHKASLSNVSRRIPIVCMAVDGEMGREVPLSDYRNIGIMAHIDAGKTTTTERILFYTGRNYKIGEVHEGTATMDWMEQEQERGITITSAATTAVWDNHRINIIDTPGHVDFTLEVERALRVLDGTICLFDSVAGVEPQSETVWRQADRYGVPRICFVNKMDRLGANFSRTRDMIVTNLGAIPLVVQIPIGAEDSFQGVVDLIKMKAVLWSGEELGAKFSYEDIPEDLLDLAMEYRNQMLENIVELDDDAMEKYLEGEEIDEKTIKKLIRKGTISIKFVPVLCGSAFKNKGVQPLLDAVVDYLPSPLDVPPLKGTDPEDPEVILERRPSDNEPFAGLAFKIMADSFVGSLTFVRVYSGKLNAASYVLNSNKGKKERIGRLLQMHANSREEVRLAVAGDIVALAGLKDTITGETLCDPDNPIVLERMNFPDPVIKVAIEPKTKADMDKMSMGLIKLAQEDPSFHFSRDEEANQTVIEGMGELHLEIIVDRLKREFKVEANVGAPQVNYRESISKTSEVRYVHKKQSGGQGQFADITVRFEPMEAGSGYEFKSAIKGGVVPKEFIPGVVKGLEECLGNGVLAGYPVVDVRAILLDGTYHDVDSSVLAFQLAARGAFREGIRKAGPRLLEPIMKVEVVTPDEHLGDVIGDLNSRRGQIHSFGDKPGGLKVVDALVPLAEMFQYVSTLRSQTKGRASYTMQLAKFDVVPQYIQNQLSTKSQEVAA

SEQ ID NO: 14137 - protein, 682 aa, Platanus occidentalis
MAHIDAGKTTTTERILYYTGRNYKIGEVHEGTATMDWMEQEQERGITITSAATTTFWNKHRINIIDTPGHVDFTLEVERALRVLDGAICLFDSVAGVEPQSETVWRQADKYGVPRICFVNKMDRLGANFFRTRDMIVTNLGAKPLVIQIPVGAEDNFQGVIDLVKMKAIIWSGEELGAKFVYADIPADLQELAQDYRTQMIETIVELDDKAMENYLEGVEPDEQTIKKLIREGTISSSFVPVLCGSAFKNKGVQPLLDAVVDYLPSPLEVPAMKGTDPENPEVTIERAPNDDEPFAGLAFKVMSDSFVGSLTFVRVYAGKLTAGSYVLNANKGKKERIGRLLEMHANSREDVRVALTGDIIALAGLKDTITGETLCEPENPIVLERMDFPDPVIKVAIEPKTKADVDKMAVGLIKLAQEDPSFHFSRDDETNQTVIEGMGELHLEIIVDRLKREFKVEANVGAPQVNYRESISKVAEVKYVHKKQSGGQGQFADITVRFEPLEAGSGYEFKSEIKGGAVPREYIPGVMKGLEECMSNGVLAGYPVVDVRAALVDGSYHDVDSSVLAFQLAARGAFREGMRKAAPKMLEPIMKVEVVTPEEHLGDVIGDLNSRRGQINSFGDKPGGLKVVDSLVPLAEMFQYVSTLRGMTKGRASYTMQLAKFDVVPQHIQNQLATKEQPLTA

SEQ ID NO: 14138 - protein, 768 aa, Triticum aestivum
MAAEALPRAAASARRPSVAAASASRLLLGHRPFLAPSASRFAAGRAAVAGPAASLRPRPRRPRLSVVAMAGNDRQVPLEDYRNIGIMAHIDAGKTTTTERILYYTGRNYKIGEVHEGTATMDWMEQEQERGITITSAATTAVWDKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVVDLIRMKAIVWTGEELGAQFSYQDIPADLEELAQDYRLQMIETIVELDDEAMEGYLEGKEPDEATVKRLIRKGTIGASFVPILCGSAFKNKGVQPLLDAVVDYLPSPLDLPPMKGTDPDDPELILERRPSDDEPFSGLAFKIMTDPYVGSLTFVRIYSGKLIAGSYVLNSNKDKKERIGRLLEMHANSKEDITVAVTGDIVALAGLKDTITGETLCDPDNLVVLERMEFPDPVIKVAIEPKTKADADKMANGLIKLAQEDPSFHFSRDEETNQTVIEGMGELHLDIIVDRLKREFKVEANVGAPQVNYRESISKIAEIQYVHKKQSGGSGQFADIIVRFEPMEAGSGYEFKSEIKGGAVPKEYVPGVMKGIEESLPNGVLAGYPVVDLRAVLVDGSYHDVDSSVLAFQIAARGAFREGLRKAGPRLLEPIMRVEVITPEEHLGDVIGDLNSRRGQVNSFGDKPGGLKVVDAFVPLAEMFQYVSTLRGMSKGRASYTMQLAKFDVVPQHIQNQLSAAKEEAAA

SEQ ID NO: 14139 - protein, 369 aa, Sorghum bicolor
MVAIENNQSQVQVAVAAEAVPVPVPGPRIPREARSLLHELAAAWADVADCRALEVVPLKGAMTNEVYQVRWLTGPAAAGEKEEPRREREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLRTAKNLCPSEEAKEFRLDSLENEITALENECSGDYQWIGFCHNDLQYGNIMIDEETNVLTIIDFEYASFNPVAYDIANHFCEMAADYHSSKPHILDYSRYPDVDEQKRFVKTYLNISGEEPDAEVVENLLQRIDKYMLASHLVWGLWGIISDHVNDIDFDYKEYARQRFEQYWQKKSAILTS

SEQ ID NO: 14140 - protein, 367 aa, Panicum virgatum
MVAIENQSQVARAAAAEAVPAAGPRIPKEARRLLHDLAAAWADVADCRALQVVPLKGAMTNEVYQVRWLTGVPSAGGEAEEPRGEREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLKTAKNLCSSDEAKEFRLDSLENEITALQNDVSGDYHWIGFCHNDLQYGNIMIDEETNMLTIIDYEYASFNPVAYDIANHFCEMAADYHSANPHILDYSKYPDTDEQKRFVKTYLSISGEEPDAEEAENLLQSIEKYTLASHLVWGLWGIISDHVNDIDFDYKEYARQRFEQYWQKKTANLQS

SEQ ID NO: 14141 - protein, 420 aa, Setaria italica
MAVDPRQVVAGFLTLSMFVMLGNMIKHDHFSSPGPQLGLEATGAEFNTMKLDDNAEMSNINTGGVENLMDADEEVKPCWTIPSPKTQPSNGYVTFSLTMGPEYHISQITDAVVVARYLGATLVLPDIRGNELGNKRKFQDMYNVDKFMRNLEGVVEVIEELPDEVSAKKPALIRVPNRVTESFITDTIQPIFQTNNYLRLAVIFSSVSLRPRETNNKDLDATACLAMFSGLELKHEYSEVARKMLDGLKELSKKSDGKVLAIDLRTDLLEKKACKTTRGARRKGCYNTDEVLGFLRSVGFSANTTIYLTETWWHKGLNDLKEEFPNTYTKDDIIPAENKGEFLKASNADLARALDLEICSQSDVFVPAIAGLFYGHVTGKRIASGRTQILVPSPSASTQASDFISTYISSKNHLAYKCYC

SEQ ID NO: 14142 - protein, 262 aa, Panicum virgatum
MAVDPRQVVAGFLTLSMFVMLGNMIKHDHFSSPGTELGLGATGAEFNTMKLDDNAELNNINTSGVESLIDTNEEVKPCWTKPSPKTQPSNGFVTFSLTMGPEYHISQITDAVVVARYLGATLVLPDIRGNELGNKRKFQDMYNVDKFMRSLDGVVEVIEELPDEVSAKKPAVIRVPNRVTESFITDTIQPIFQTNNYLRLAIIFSSVSLRPRETNNKDLDATACLAMFSGLELKHEYSEVARKMSDKLKEISKKSDGKVLAN

SEQ ID NO: 14143 - protein, 420 aa, Pennisetum glaucum
MAVDPRQVVAGFLTFSMFIMLGNMIKHDHFSSPGTQLDLEATGAEFNTMKLDDNAEMNNINTGGVENLMDAEEEVKPCWTKPSPKTQPSNGYVTFSLTMGPEYHISQITDAVVVARYLGATLVLPDIRGTKLGNKRKFQDMYNVDKFMRSLDGVVEVIDELPDEVSAKKPALVRVPNRVTENFITDTIQPIFQTNNYLRLAVIFSSVSLRPREMNNKDLDATACLAMFSGLELKHEYSEVARKMLDGLKELSKKSDGKVLAIDLRTDLLETKACKTTRGARRKGCYSADEVLGFLRSVGFSANTTIYLTETWWHKGLNDLKEEYPNTYTKDDIIPAENKGEFLKSTNADLARALDLEICSQSDVFVPAIAGLFYGHVTGKRIASGHTQILVPSPSASTQASDFISTYISSKNHLAYKCYC

SEQ ID NO: 14144 - protein, 355 aa, Trigonella foenum-graecum
MSSEVVGEDCLSWAARDASGVLSPYKFNRRDLGSEDVYVKITHCGVCYADVIWARNKHGDSKYPVVPGHEIAGVVAKVGPNVQRFKVGDHVGVGTYINSCRECEYCNDRLENHCAKGSVYTFNGVDYDGTITKGGYSNSIVVNERYCFMIPKSYPLASAGPLLCAGITVYSPMMRHKMNQPGKSLGVIGLGGLGHMAVKFGKAFGLRVTVFSTSMSKKEEALSLLGADKFVVSSNQEEMRALAKSLDFIIDTASGDHPFDPYMSLLKISGVLVLVGFPSEVKFSPASLNLGSRTVAGSVTGGTKEIQEMVDFCAANGIHPDIELIPIGYSNEALERVINKDVKYRFVIDIENSLK

SEQ ID NO: 14145 - protein, 357 aa, Glycine max
MSSKGVGEDCLGWAARDASGVLSPYKFSRRTLGNEDVHIKITHCGVCFADVVWTRNKHGDSKYPVVPGHEIAGIVTKVGANVHHFKVGDHVGVGTYINSCRDCEYCNDGQEVHCTKGSVYTFNGVDFDGTITKGGYSSYIVVHERYCFMIPKSYPLASAAPLLCAGITVYSPMVRHKMNQPGKSLGVIGLGGLGHMAVKFGKAFGLSVTVFSTSISKKEEALSLLGADKFVVSSNQEEMTALAKSLDFIIDTASGDHSFDPYMSLLKTYGVFVLVGFPSQVKFIPASLNIGSKTVAGSVTGGTKDIQEMIGFCAANEIHPNIEVIPIEYANEALERLINRDVKYRFVIDVENSLKEK

SEQ ID NO: 14146 - protein, 354 aa, Cajanus cajan
MSSQGIVEDCLGWAARDASGVLSPYKFSRRTLGNEDVYIKITHCGVCYADVAWTRNKLGDSKYPVVPGHEIAGIVTKVGSNVHRFNVGDHVGVGTYVNSCRDCEYCNDRLEVHCTKGSIYTFNGVDFDGTITKGGYSSYIVVHERYCFIIPKSYPLASAAPLLCAGITVYSPMVRHKMNQPGKSLGVIGLGGLGHMAVKFGKAFGLNVTVFSTSISKKEEALSLLGADKFVVSSNQEEMKALAKSLDFIIDTASGDHPFDPYMSLLKTYGVFVVVGFPSEIKFMPANLILGSKTVAGSVTGGTKDIQEMIDFCAAKGIYPNIEVIPIEYANEALDRLINKDVKYRFVIDIENSL

SEQ ID NO: 14147 - protein, 355 aa, Cajanus cajan
MSSQGVAEDCVGWAARDESGVLSPHKFSRRALGNEDLHIKITHCGVCYADVVWTRNLHRDSMYPVVPGHEIAGIVTKVGSNVHSFNVGDHVGVGTYVSSCRDCEYCNDRLEVHCTKGSVYTFNGVDFDGTITKGGYSSYIVVHERYCFMIPKSYPLASAAPLLCAGITVYSPMVRHKMNQPGKSLGVIGLGGLGHMAVKFGKAFGLSVTVFSTSISKEEEALSLLGADKFVVSSNQEEMTALAKSLDFIIDTASGDHPFDPYLSLLKTYGVFVLVGVPSEVKFSPVSLVIGSKTVAGSITGGTKDIQEMIDFCAANGIYPNIELIPIEYANEALERLINKDVKYRFVIDIENSLK

SEQ ID NO: 14148 - protein, 338 aa, Castanea mollissima
MADQNLKPELFELDNGTMRVLITNLGCTITSLSVPDKDGKLADVVLGFDSLEPYLKGAAPYFGSIVGRVANRIKDGKFKLNGVDYSLPINKPPNSLHGGHKGFDKKVWEATNITKGENPSITFKYHSSDGEEGYPGDVSVTATYTLTSSTTMRLDMEAVPNKPTPISLAQHTYWNLAGHNSGNILDHSIQIMANHVTPVDQNTIPTGEIMPVKGTPFDFTAEKRIGESIHEVGLGYDHNYVLDCGEEKAGLKHAAKVKDPSSSRILNLWSNAPGMQFYTGNYVNGVVGKGGAVYGKHAGLCLETQGFPNAINQPNFPSIVVQPGEKYQHTMLFEFSVE

SEQ ID NO: 14149 - protein, 338 aa, Quercus alba
MADQNLKPELFELNNGTMRALITNLGCTITSLSVPDKDGKLADVVLGFDSLEPYLKGAAPYFGSIVGRVANRIKDGKFKLNGVDYSLPINKPPNSLHGGHQGFDKKVWEATNITKGENPSITFKYHSSDGEEGYPGDVSVTATYTLTSSTTMRLDMEAVPNKPTPISLAQHTYWNLAGHNSGNILDHSIQIRANHVTPVDQNTIPTGEIMPVKGTPFDFTAEKRIGESIHEVGLGYDHNYVLDCGEEKAGLKHAAKVKDPSSSRILNLWSNAPGMQFYTGNYVNGVVGKGGAVYGKHAGLCLETQGFPNAINQPNFPSIVVQSGEKYQHTMLFEFSVE

SEQ ID NO: 14150 - protein, 353 aa, Trigonella foenum-graecum
MAATQTQLIPHVTLGTQGFQVSKLGFGCMGLTGAYNDPLPEQDAISVINYAFSKGITFFDTADVYGVTGANEILLGKALKQLPREKIQVATKFGISRRDGSGITGMSIKGSPDYVRSCCEASLKRLGVEYIDLYYQHRVDTSMPIEDTVGELKKLVEEGKVKYIGLSEASPDTIRRAHAVHPITAVQIEWSLWTRDVEDEIVPLCRDLGIGIVPYSPLGRGFFGGKGVLENVPAVSSLTSHPRFQAENLDKNRSIYDRIESLGKKHGCTPAQLALAWVLQQGQDVVPIPGTTKIKNLDQNLCALAVKLSEEDLREISAAVPVDDIAGSRYYNGLDHFSWKFANTPPKVSRVST

SEQ ID NO: 14151 - protein, 532 aa, Glycine max
MECVAARNLAAMAFCVSPLSSRLRLRRKKLWRRRTASSSSSCGGRGVRCLKVEAKAGSESCVATKEDFADEEDYVKAGGSELVFVQMQQNKAMEMQSKLADKLPPIGDDILDLVVIGCGPAGLALAAESAKLGLKVGLIGPDLPFTNNYGVWEDEFKDLGLEGCIEHVWKDTIVYLDNKDPIFIGRSYGRVSRHLLHEELLRRCVESGVSYLSSRVESVIETSNGHSHVVCEYDVVVPSRLVTVASGAASGKLLQYEVGGPKVSVQTAYGVEVEVENNPYDPNLMVFMDYRDYMKQNVQCPEANYPTFLYAMPMSHTKVFFEETCLASKDAMPFDLLKKKLFSRLNTMGIRIKKTYEEEWSYIPVGGSLPNTEQKNLAFGAAASMVHPATGYSVVRSLSEAPKYASVIATILKDGHAKDIITQERRKENLSMQAWNTLWPQERKRQRAFFLFGLALILQLDIEGIRTFFRTFFCLPDWMWQGFLGSSLSSTDLVLFAFYMFIIAPNNLRMGLVRHLLSDPTGATMIKTYLTI

SEQ ID NO: 14152 - protein, 533 aa, Glycine max
MECVAARNLAAMAFCVSPSSSRLRLRRKKLWRRRAASSSSSCGGGRGVRWLKVEAKAGSESCVATKEDFADEEDYVKAGGSELVFVQMQQKKAMEMQSKLADKLPPIGDDILDLVVIGCGPAGLALAAESAKLGLKVGLIGPDLPFTNNYGVWEDEFKDLGLEGCIEHVWKDTIVFLDNKDPIFIGRSYGRASRHLLHEELLRRCVESGVSYLSSRVESIIEATNGHSHVVCEYDIVVPSRLVTVASGAASGKLLQYEVGGPKVSVQTAYGVEVEVENNPYDPNLMVFMDYRDYMKQNVQCPEANFPTFLYAMPMSRTRVFFEETCLASKDAMPFDLLKKKLFSRLNTMGIRITKTYEEEWSYIPVGGSLPNTEQKNLAFGAAASMVHPATGYSVVRSLSEAPKYASVIATILKDGHAKDIITQERRKENLSMQAWNTLWPQERKRQRAFFLFGLALILQLDIEGIRTFFRTFFCLPDWMWQGFLGSSLSSTDLVLFAFYMFIIAPNNLRMGLVRHLLSDPTGATMIKTYLTI

SEQ ID NO: 14153 - protein, 530 aa, Vigna unguiculata
MECVSARNLAAMAFCVSPSPRLRLRKKKLWRRRTASGGHGVRWRSRWLKVEAKAGGESCVATKEDFADEDDYVKAGGSELVFVQMQQNKAMEMQSKLVDKLAPIGDDILDLVVIGCGPAGLALAAESAKLGLKVGLIGPDLPFTNNYGVWEDEFRGLGLEGCIEHVWKDTVVYLDNKDPVFIGRSYGRVSRHLLHEELLSRCVESGVTYLSSRVENIIEASNGHSHVVCEYDIIVPSRLVTVASGAASGKLLQYEVGGPKVSVQTAYGVEVEVENNPYDPNVMVFMDYRDYVKQNVQGLEANYPTFLYAMPMSRTRVFFEETCLASKDAMPFDLLKKKLFLRLNSMGIRITKTYEEEWSYIPVGGSLPNTEQKNLAFGAAASMVHPATGYSVVRSLSEAPKYASVIANILKDGHAKDNITQERRKENLSMQAWNTLWPQERKRQRAFFLFGLALILQLDIGGIRTFFRTFFCLPDWMWQGFLGSSLSSTDLVLFAFYMFIIAPNNLRMSLVRHLLSDPTGAIMIKAYLAV

SEQ ID NO: 14154 - protein, 536 aa, Cajanus cajan
MECVGARNVAAMAFCVSPASRLRLRRKKLWRRRASSSSSSSGHGVRCRSRWLKVEAKAGSESCVATKEDFADEEDYVKAGGSELVFVQMQQNKAMEMQSKLADKLPPISIGDDILDLVVIGCGPAGLALAAESAKLGLNVGLIGPDRPFTNNYGVWEDEFKGLGLEGCIEHVWKDTVVYLDNKDPVLIGRSYGRVSRHLLHEELLRRCVESGVSYLSSRVESIVEASNGLSHVVCEYDIVVPCRLVTVASGAASGKLLQYEVGGPKVSVQTAYGLEVEVENNPYDPNLMVFMDYRDYMKQNVQCPEANYPTFLYVMPMSRTRVFYEETCLASKDAMPFDLLKKKLFSRLNTMGIRIAKIYEEEWSYIPVGGSLPNTGQKNLAFGAAASMVHPATGYSVVRSLSEAPKYASVIATILKDGHAKDVFSLERRKENLSMQAWDTLWPQERKRQRAFFLFGLALILQLDIEGIRTFFRTFFCLPDWMWKGFLGSSLSSTDLVLFAFYMFIIAPNNLRMSLVKHLLSDPTGATMIKTYLTI

SEQ ID NO: 14155 - protein, 148 aa, Trigonella foenum-graecum
MAGLRIITFVSFMVAMVLLMINTTEAQTTEIPSCASNLIPCAGYLNSTKPPSSCCDPIKKTVETELTCLCNLFYAPGLLQSFNISTAQALTLSRNCGVTSDLTSCRHNGSAPAPTAGGSPPGRDKGAAGRVSFTGFSFLVLLASMLFN

SEQ ID NO: 14156 - protein, 815 aa, Glycine max
MKVQETRSHVHALGEEEKVMTRKQKAESKAHEVEHSPKKAKVEKEDGHINGKSETGVAEEYDEFCKATTEHLPLEQMRDILEANGLDSSGSDLEITRRCQDLLFYGALDKCSVCNGSLEFDGRRYVCRGFYSEWASCTFSTRNPPRKQEPIKLPDSVQNSLASDLLKKYQDPSHRPHRDLGLAEKPFTGMMISLMGRLTRTHHYWKTTIEKHGGKVANSIIGSTCLVASPAERERGGTSKLAEAMERSIPVVREAWLIDSIEKQEPQPLEAYDLVSDLSVDGKGIPWDKQDPGEEAIESLSAELKLYGKRGVYKDTKLQEQGGKIFERDGILYNCAFSVCDQGRGLNDYCVMQLIVVPENRLHLYFKKGRVGDDPNAEERLEEWDNVDGALKEFVRLFEEITGNEFEPWEREKKFQKKPLKFYPIDMDDGIEVRHGALGLRQLGIAATHCKLEPLVANFMKVLCSQEIYKYALMEMGYDCPDLPIGMVTNLHLKKCEDVLLEFIDKVKSLKETGPKAEAVWTDFSQRWFTLMHSTRPFNFRDYQEIADHAAAALEGVRDITQASHLIGDMTGSTIDDPLSETYKKLGCSISALDKSSDDYEMIVKYLEKTYEPVKVGDIEYGVSVENIFAVQTGGCPSYEDIIKLPNKVLLWCGSRSSNLLRHLQKGFLPAICSLPIPGYMFGKAIVCSDAAAEAARYGFTAVDRPEGFLVLAIASLGNEITELKTPPEDASSLEEKKVGVKGPGKKKTDESEHFVWKDDIKVPCGKLVASDHQDSPLEYNEYAVYDKKRARISYLVGVKYEEKEEKGAVIDTAE

SEQ ID NO: 14157 - protein, 461 aa, Cajanus cajan
MQLIVVPENRLNLYFKKGRVGDDPNAEERLEEWDNVDSALKEFARLFEEITGNEFEPWEREKKFQKKPLKFYPIDMDDGVEVRHGALGLRQLGIAVTHSKLEPLVANFMKVLCSQEIYKYALMEMGYDSPDLPIGMVTNLHLKRCEDVLLEFIDKVKALKETGPKAEAVWTDFSQRWFTLMHSTRPFNFRDYQEIADHAAAALEGARDITLASHLIGDMSGATIDDPLSETYKKLGCSVSPLDKSSNDYEMIVKYLEKTYEPVKVGDIDYGVSVENIFAVQTGGCPSYEDIVKLPNKVLLWCGSRSSNLLRHLHKGFLPAICSLPVPGYMFGKAIVCSDAAAEAARYGFTAVDRPEGFLVLAIASLGNEITELKSPPEDTSSLEEKKIGVKGLGKKKTDESEHFVWKDDIKVPCGRLVASDHQDSPLEYNEYAVYEPKQVRISYMVEVKYEETGAVIDTTE

SEQ ID NO: 14158 - protein, 267 aa, Glycine max
MASALSTTSVLCWRNPQHMHIISPSSQTLQNGTLRTVAASASKDISIESDKCSSLLVNRRTILASGVSLLSFPGESLAVVKQGLLAGRIPGLSEPDEQGWRTYRRPDEKSGGHGVGWSPIIPYSFRVPEEWEEVPVSIADLGGTEIDLRFASSKEGRLFVIVAPVLRFSDDLGDNATIEKIGPPEKVINAFGPEMIGENVEGKVLSVSAAEHEGRTYYQFELEPPHIFITATAAGNRLYLFGVTGSGLQWKRHYNDLKKIAESFRVV

SEQ ID NO: 14159 - protein, 271 aa, Cajanus cajan
MATALSTTSVLRWRNPQHMHISPSSQTLCHSSLQNGTLRTVAASASKDINRESEKGSSLLVNRRTVLASGVSLLGFPGESLAVVKQGLLAGRIPGLSEPDEQGWRTYRRPDEKSGGHGVGWSPIIPYSFRVPEEWEEVPVSIADLGGTEIDLRFASSKEGRLFVIVAPVLRFSDNLGDNATIEKIGPPEKVINAFGPEMIGENVEGKVLSSNVAEHEGRTYYQFELEPPHIFITATAAGNRLYLFGVTGSGLQWKRHYDDLKKIAESFRVV

SEQ ID NO: 14160 - protein, 271 aa, Glycine max
MATTALSTTSVLCRRKPQHMHIILPSSQTLQNGTLRTDVTASASKDNISIESEKCCSSLLVNRRTVLASGVSLLGFPGESLAVVKQGLLAGRIPGLSEPDEQGWRTYRRPDEKSGGHGVGWSPIIPYSFRVPKEWEEVPVSIADLGGTEIDLRFASSKEGRLFVIVAPVLRFSDDLGDNATIEKIGPPEKVINAFGPEMIGENVEGKVLSANVAEHEGRTYYQFELEPPHIFITATAAGNRLYLFGVTGSGLQWKRHYDDLKKIAESFRVV

SEQ ID NO: 14161 - protein, 268 aa, Phaseolus coccineus
MATALSTTTVLCWRNPQHMHVPTSPHTLCHSSQQIGILRTLTTLASKDRESEKCSSLVNRRTILAAGVSLLGFPGESLAVVKQGLLAGRIPGLSEPDEQGWRTYRRPDEKSGGHGVGWSPIIPYSFRVPQEWEEVPVSIADLGGTEIDLRFASSKEGRLFVIVAPVLRFSDDLGDNATIEKIGPPEKVINAFGPEVIGENVEGKVLSSNVAEHEGRTYYQFELEPPHVFITATAAGNRLYLFAVTGSGLQWKRHYDDLKKIAESFRVV

SEQ ID NO: 14162 - protein, 191 aa, Lotus japonicus
MISQLGRGFKALIPDLYRGKVGLDVAEAQHLFDGLDWQGAVKDVRASVDWLKTNGSRKAGVTGFCMGGALAIASSVLVPDVDAAVAFYGFPSSELADPAQAKAPVQAHFGELDDFVGFSDVTAAKALEEKLKASGVPHEVHIYPGNRHAFMNRSPEGINRRKSMGMPDEDEAAVQLAWSRFQSWMTHYLSS

SEQ ID NO: 14163 - protein, 243 aa, Populus trichocarpa
MAGSASQPFKKIQIQRDDTTFDAYVVGKEDAPGIVVLQEWWGVDFEIKNHAVKISQLGPGFKALIPDLYRGKVGLDVAEAQHLMDGLDWQGAVKDIQASVNWLKTNGSSKAGVTGFCMGGALSIASSVLVPEVDAVVAFYGVPSSQLADPAQAKAPVQAHFGELDNFVGFSDVTAAKALEEKLKASGIPYEVHIYPGNAHAFMNRSPEGVMRRKGMGLPDEDEASAELAWSRFTTWMTRYLSA

SEQ ID NO: 14164 - protein, 353 aa, Phaseolus coccineus
MSSQTAAAEAPLLRNRQDAARAPALALLLGRAGRRGPSMLVRETAARELEERRADWGYSKPVVALDMSWNMAFVVVSVVMLACTTGERPNSPIRVWIVGYGLQCLVHVVLVWVEYRRRSRRDSRRGQGARDLESQAGSDNDDGGNDSDSDDGDGSSGNSSRSRFTKRCESLNTGVSFLWWIVGFYWVVSGGDILLQDAPRLYWLAVVFLAFDVFFAIFCVVLACLIGIALCCCLPCIIAILYAVAGQEGASEADLSILQKYRFRIPSNEDKSSGGGGSMVPIETSSAYLATERILLPEDAECCICLCSYEDGAELHALPCNHHFHSSCIVKWLKMNATCPLCKYNILKGNEQV

SEQ ID NO: 14165 - protein, 606 aa, Tripterygium wilfordii
MFGVSTAATASRTTAVFAANSLGSRLPLSQRHTTPLSCSVSQQVHTTSLRSCCNHPVKAMAEHQTTSVPNNELKASASSSGKKQALISLSDKNDLALLGTGLQELGYTIVSTGGTASTLENAGVCVTKVEELTCFPEMLDGRVKTLHPNVHGGILARRDQKHHMEALSKHGIGTFDVVVVNLYPFYDKVTSTGGIAFEDGIENIDIGGPAMIRAAAKNHKDVLVVVDAQDYPALLEFLKGNQDDQQFRRKLAWKAFQHVASYDSAVSEWLWKQTVGDKFPPRLTVPLELKSSLRYGENPHQNAAFYTDKSLSEVNAGGIATAIQHHGKEMSYNNYLDADAAWNCVSEFRNPTCVVVKHTNPCGVASRDDILEAYRLAVKADPVSAFGGIVAFNIEVDEALAKEIREFRSPTDGETRMFYEIVVAPSYTKKGLEILRGKSKTLRILEAKKNEKGKLSLRQVGGGWLAQDSDDLTPKDIKFNVVSRRTPEESELSDAEFAWLCVKHVKSNAIVIAKNNCMLGMGSGQPNRLESLRIALKKAGEEVKGAALASDAFFPFAWKDAVEEACESGVGVIAEPGGSIRDGDAIDCCNKYEVSLLFTNVRHFRH

SEQ ID NO: 14166 - protein, 305 aa, Zea mays
MECLTTSFPRNVGKEYICSSKLVSGNQWIPKRICCYVSCSTNSSRCHKFTDVACPMSPVIRKRLRWRCFAASLNLEDGPAPSDSTSSSSEQTTDADGTTNGDVSENLLSRKPSSDELKALLADSERSRLLRRLSEANQYNRFLKRQLQIKDDAVVKFKGELAVLELEMQALVGLAEEVANFDVPLGSRKINGKYIQSHLLSRLEAVHDKIMEQVKSVDALKTQEIPVYWIGMAENVQIMGSFDGWSQGEAMSMEYSGDYGRFSATLKLRPGRYEIKFLVDGEWRLSPEYPTAGDGLTQNNILVVE

SEQ ID NO: 14167 - protein, 590 aa, Zea mays
MGRGGARAAPAAAVPPWHALPDEVWEHAFSFLPADSDRGAAACACHAWLRFERRSRRRLAVANCYAASPRDAVERFPAVRAVEVKGKPHFADFGLVPPAWGADAAPWVAAAAAGWPLLEEISFKRMVVTDDCLEMIAASFRNFQVLRLVSCEGFSTAGLAAIAAACRNLRELDLQENEIEDCSIHWLSLFPVSFTSLVTLNFSCLEGDVNITVLEQLVTRCSNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFEAAEQVSLTERGLVDVSASCPMLESVLYFCRRMTNEALITIAKNRPNFTCFRLCIIEPHTPDYITHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSMTLGACRQLARKMPRLSVEVMNDPRRGFPLDSLTDESPVETLYVYRTISGPRSDTPACVQIL

SEQ ID NO: 14168 - protein, 590 aa, Setaria italica
MGRGGSRAAPAAAMPPWHALPDEVWEHAFSFLPADSDRGAAAAACRSWLRAERRSRRRLAVANCYAASPQDAVERFPSVRAVEVKGKPHFADFGLVPPGWGAAAAPWVAAAADGWPLLEELSFKRMVVTDDCLEMIAASFRNFQVLRLVSCEGFSTAGLAAIAAGCRNLRELDLQENEIEDCSIHWLSLFPESFTSLVTLNFSCLEGDVNITVLERLVTRCRNLKTLKLNNSIPLDKLASLLRKAPQIVELGTGRFSADYHLDLFSKLEAAFAGCKNLRRLSGAWDAVPEYLPAFYCVCEGLTSLNLSYATVRGPELIKFVSRCKNLQLLWVMDLIEDHGLAAVASSCNKLQELRVFPSSPFDAAEQVSLTERGLVDVSAGCPMLESVLYFCRRMTNEALITIAKNRPNFTCFRLCIIEPHTPDYITHQPLDAGFSAIVESCKGLRRLSVSGLLTDRVFKSIGAHADRLEMLSIAFAGNSDLGLHYILSGCKSLKKLEIRDCPFGDKPLLANAAKLETMRSLWMSSCSLTLGACRQLARKMPRLSVEVMNDPRRACPLDSLTDESPAETMYVYRTIAGPRSDTPTWVQIV

SEQ ID NO: 14169 - protein, 199 aa, Setaria italica
MGRGGSRAAPAAAMPPWHALPDEVWEHAFSFLPADSDRGAAAAACRSWLRAERRSRRRLAVANCYAASPQDAVERFPSVRAVEVKGKPHFADFGLVPPGWGAAAAPWVAAAADGWPLLEELSFKRMVVTDDCLEMIAASFRNFQVLRLVSCEGFSTAGLAAIAAGCRNLRELDLQENEIEDCSIHWLSLFPESFTSLVT

SEQ ID NO: 14170 - protein, 590 aa, Brachypodium distachyon
MGRGVGSRSGGGAAQPPWHSLPDEVWEHAFSFLPAAADRGAAAGACRGWLRAERRSRRRLAVANCYATSPRDAVERFPSVRAAEVKGKPHFADFGLVPPAWGAEAAPWVAAAADGWPLLEELSFKRMVVTDECLEMIAASFRNFQVLRLVSCEGFSTAGLAAITEGCRNLRELDLQENYIEDCSSHWLSSFPESFTSLETLNFSCLDGEVNFAVLERLVTRCHNLKTLKLNNAIPLDKVASLLRKAPHIVELGTGKFSADYHPDLFAKLEAAFAGCKSLRRLSGAWDAVPDYLSAFYGVCEGLTSLNLSYATVRGPELIKFISRCKNLQQLWVMDLIEDHGLAVVASTCSKLQELRVFPSDPFGAGQVLLTERGLVDVSASCPMLESVLYFCRRMTNEALITIAKNRPNFTCFRLCILEPRTPDYITQQSLDAGFSAIVESCKGLRRLSVSGLLTDLVFKSIGEHADRLEMLSIAFAGNSDLGLHYILSGCKSLKKLEIRDCPFGNKPLLANAAKLETMRSLWMSSCSLTLGACRQLAQKMPRLTVEIMNDPGRACPLDALPDESPVEKLYVYRTIAGPRSDTPDYVQIV

SEQ ID NO: 14171 - protein, 594 aa, Oryza sativa
MGRGGSRAACAAAAPPWHSLPDEVWEHAFSFLPAAADRGAAAGACSSWLRAERRSRRRLAVANCYAAAPRDAVERFPSVRAAEVKGKPHFADFGLVPPAWGAAAAPWIAAAADGWPLLEELSFKRMVVTDECLEMIAASFRNFQVLRLVSCDGFSTAGLAAIAAGCRHLRELDLQENEIEDCSIHWLSLFPESFTSLVTLNFSCLEGEVNITVLERLVTRCHNLKTLKLNNAIPLDKLASLLHKAPQLVELGTGKFSADYHSDLFAKLEAAFGGCKSLRRLSGAWDAVPDYLPAFYCVCEGLTSLNLSYATVRGPELIKFISRCRNLQQLWVMDLIEDHGLAVVASSCNKLQELRVFPSDPFGAGFLTERGLVDVSASCPMLESVLYFCRRMTNEALITIAKNRPNFTCFRLCILEPHTPDYITREPLDAGFSAIVESCRGLRRLSISGLLTDLVFKSIGAHADRLEMLSIAFAGNSDLGLHYILSGCKSLKKLEIRDCPFGDKPLLANAAKLETMRSLWMSSCLLTLGACRQLARKMPRLSVEIMNDPGRSCPLDSLPDETPVEKLYVYRTIAGPRCRMKIHSLFQDMEMHGL

SEQ ID NO: 14172 - protein, 362 aa, Glycine max
MPKTSKVITCKATICWGIGKPITVEEIQVDPPKATEVRVKMLCASICHTDISSTEGFPHGKFPLALGHEGVGVIESVGDQVKNLKEGDVNCVSEKTNLCLKYPVMWTGLMPDNTSRMSIRGERIYHITSCATWSEYMVSDANYILKVDPTIDRAHASFISCGFSTGFGAAWKEANVESGSTVAVFGLGAVGLGAVIGAKLQGASRIIGIDTNENKREKGEAFGITDFINPGDSDNSASELVKELTGGMGVDYSFECTGVSTVLTESLEATKIGTGKTIVISVGAEPILPVGLFAILHGRTLKGTLFGGLKAVSDLSIVAEKCQKKEFPLQELFTHEVTLADINKAFELVKQPNCVKVVINMS

SEQ ID NO: 14173 - protein, 376 aa, Glycine max
MPNTSQVISCKAAICWGAGKPVTVEEIQVDPPKATEVRVKMLCASLCHTDISSIQGFPYINFPLALGHEGVGVVESVGDQVRNLKEGDVVIPTYIGECQECENCVSGKTNLCLTYPIRLTGLLPDNTSRMSIRGQRLHHVLSCATWSEYMVSDANYTLKVDPTIDPAHASFISCGFSTGYGAAWKEAKVESGSSVAVFGLGAVGLGAISGAKMLGATKIIGIDKNEMKREKGEAFGMTDFIKAGDSAKSVSELVKEMSGGMGVDYSFECSGVAPLLTESVEATKVGTGKTIAIGTGTEPIIPFGLTSIMYGRTLKGSVFGGLKAISDLSIVANKCQKEEFPLQELFTHEVPLTDINKAFELLKKPNCVKVVIKMSH

SEQ ID NO: 14174 - protein, 715 aa, Solanum phureja
MGKLGKKARKFAKKNLPSVLRDRRKKKALFKKRYSSKNVQSNVEDQAKLIDHSNERNTEVEAFEDLPLEAPFMENDCDGVVDSSDSDGYLSEDISYENETESEPGKLLEGDKCTSELMMQNIKIQENLAGQKRKLERLKRKDPSFSKFLEKHKDIEAMQNGVVFSDEDEMSNHGRDSVAEDNQGKNKGRVLTVSAISSWCRLIKEEHKEEAFVCLLNAYRAACHYGAESIGLRFQNAETFCSLVMSVLSEADNILRGLLGLSSSSYKKEAVLELKDTPQWVNVKPLIKSYLRSTLSLLDQVTDSEILAFALTRLRDSLPFFAAFPYLLQRLIKTTIHLWATGGGMLSSASFSIVLDVASLFTTDFFDNCLAKAFVAYLAQSRATDIVNNKHLQFLRNSLVDLCSLDVQKSLSKATVSVRQLAKVLQWGLRTKKKEALQRICSWEYANCINLWVGFIARNVRDYDLQAFFFTMVQLINGVVRLFPGPRYFPLRLNCIQWLNDLSNSTGVFIPITSFVLDVLEYKTVGGRGKPGPTLFFQSVLKLPKSCLKSQTFQDECITSAIEQLSSHFLQWSYHISFPELATVPLIRLKKFNESKTKESLCRAVKHLIEQVEKNVDSVQKKRNEVAFSPNDHQSVETFLQFEKSSLSSPFSQYYRSVLDKAALRGSHKNEKISLPRRDKSKRKRDDSLINVSGHKDLDTVNGAKKRVKRRAPKA

SEQ ID NO: 14175 - protein, 583 aa, Solanum tuberosum
MEDKSIPFESTHSVSNNDNNHGWQKVTYVKKQKKKQQKLSDSGKVIANGSAISGADNVYKSLEKHSDERRKRIAAHTAAMYGVGDAPVRSAMKHRSDDEDEDNDAEGGAENGVAGEKKKDKVKKPKKPKVTVAEAAAKIDAADLDAFLADITVSYESQQEIQLMRFADYFGRSFAAVAGSQFPWLKLFRESPISKIADVPVSHLPEPVYKTSVDWINQRSFEALGSFVLWGLDSILVDLTAQLAGSKGSKKGGQQTSSKSQVAMFLVLAMVLRRKPDVLITILPTLRESPKYQGQDKLIVIAWMIVQACQGDLCVGLYLWAHHTLPLVGGKSGSNPQTRDLILQVVERILSAPKARTILVNGAVRKGERLMPPSSLDLLLRVTFPAPSARVKATERFEAVYPTLKEVALAGSPGSKAMKQVSQQILLLAVKAVGGGNPELSREAANIFNWCLTQSADCYKLWDKIYLDNIEASVAVLRKLTEGWKELLRRQSSPEALKETLKSFRQKNEKSLTGGVDAHQSHFRDADKYCKMLLARLSRGHGCLKGFVVVLLAMAVGGAIVSQNLEDWDLNKFSALLNVPQSS

SEQ ID NO: 14176 - protein, 583 aa, Solanum phureja
MEDKSIPFESSHSVSNNDNNHGWQKVTYVKKQKKKQQKLSDSGKVIANGSAISGADNVYKSLEKHSDERRKRIAAQTAAMYAVGDAPVRSAMKHRSDDEDEDNDAEGGAENGVVGEKKTDKVKKPKKPKVTVAEAAAKIDAADLDAFLADITVSYESQQEIQLMRFADYFGRSFAAVAGSQFPWLKLFRESPISKIADVPVSHLPEPVYKTSVDWINQRSFEALGSFVLWGLDSILVDLTAQLAGSKGSKKGGQQTSSKSQVAMFLVLAMVLRRKPDVLITILPTLRESPKYQGQDKLTVIPWMIVQACQGDLCVGLYLWAHHTLPLVGGKSGSNPQTRDLILQVVERILSAPKARTILVNGAVRKGERLMPPSSLDLLLRVTFPAPSARVKATERFEAVYPTLKEVALAGSPGSKAMKQVSQQILLLAVKAVGGGNPELSREAANIFNWCLTQSADCYKQWDKIYLDNIEASVAVLRKLTEGWKELSRRQSSPEALKETLKSFRQKNEKSLTGGVVAHQSHLRDADKYCKMLLARLSHGHGCLKGFVVVLLAMAVGGAIVSQNLEDWDWNKFSALLNVPQSS

SEQ ID NO: 14177 - protein, 421 aa, Eutrema halophilum
MFGRGPSKKSDNTKFYEILGVPKTASPEDLKKAYKKAAIKNHPDKGGDPEKFKELAQAYEVLSDPEKREIYDQYGEDALKEGMGGGGGGHDPFDIFSSFFGGSPFGGGGSSRGRRQRRGEDVVHPLKVSLEDVYLGTTKKLSLSRNALCSKCNGKGSKSGASLKCGGCQGTGMKVTIRQLGPGMIQQMQHACNECKGTGETINDRDRCPQCKGDKVIPEKKVLEVNVEKGMQHSQKITFEGQADEAPDTVTGDIVFVLQQKEHPKFKRKGEDLFVEHTLSLTEALCGFQFVLTHLDGRNLLVKSNPGEVVKPDSYKAISDEGMPIYQRPFMKGKLYIHFTVEFPDSLSPNQTKALEAVLPKPSTTQLSDMEIDECEETTLHDVNIEDEMRRKAQAQREAYDDDDDDDEHPGGAQRVQCAQQ

SEQ ID NO: 14178 - protein, 421 aa, Arabidopsis lyrata
MFGRGPSKKSDNTKFYEILGVPKNASPEDLKKAYKKAAIKNHPDKGGDPEKFKELAQAYEVLSDPEKREIYDQYGEDALKEGMGGGGGGHDPFDIFSSFFGRSPFGDGGSSRGRRQRRGEDVVHPLKVSLEDVYLGTMKKLSLSRNALCSKCNGKGSKSGASMKCGGCQGSGMKVSIRQLGPGMIQQMQHACNECKGTGETINDRDRCPQCKGDKVIPEKKVLEVNVEKGMQHSQKITFEGQADEAPDTVTGDIVFVLQQKEHPKFKRKGEDLFVEHTLSLTEALCGFQFVLTHLDGRNLLIKSNPGEVVKPDSYKAISDEGMPIYQRPFMKGKLYIHFTVEFPDSLSPDQTKALEAVLPKPSTTQLSDMEIDECEETTLHDVNIEDEMKRKAQAQREAYDDDDEDDDHPGGAQRVQCAQQ

SEQ ID NO: 14179 - protein, 420 aa, Arabidopsis thaliana
MFGRGPSKKSDNTKFYEILGVPKSASPEDLKKAYKKAAIKNHPDKGGDPEKFKELAQAYEVLSDPEKREIYDQYGEDALKEGMGGGGGGHDPFDIFSSFFGGGPFGGNTSRQRRQRRGEDVVHPLKVSLEDVYLGTMKKLSLSRNALCSKCNGKGSKSGASLKCGGCQGSGMKVSIRQLGPGMIQQMQHACNECKGTGETINDRDRCPQCKGDKVIPEKKVLEVNVEKGMQHSQKITFEGQADEAPDTVTGDIVFVLQQKEHPKFKRKGEDLFVEHTLSLTEALCGFQFVLTHLDGRSLLIKSNPGEVVKPDSYKAISDEGMPIYQRPFMKGKLYIHFTVEFPDSLSPDQTKALEAVLPKPSTAQLSDMEIDECEETTLHDVNIEDEMRRKAQAQREAYDDDDEDDDHPGGAQRVQCAQQ

SEQ ID NO: 14180 - protein, 121 aa, Raphanus sativus
MFGRGATKKSDNTKFYEILGVPKTASPEDLKKAYKKAAIKNHPDKGGDPEKFKELAQAYEVLSDPEKREIYDEYGEDALKEGMGGGGGGGHDPFDIFSSFFGGGSPFGGGGSSRGKEAEAW

SEQ ID NO: 14181 - protein, 420 aa, Unknown
  Sequence found in Organisms: Thellungiella halophila, Eutrema halophilum
MFGRGPSRKSDNTKFYEILGVPKTASPEDLKKAYKKAAIKNHPDKGGDPEKFKELAQAYEVLSDPEKREVYDQYGEDALKEGMGGPGGGHDPFDIFSSFFGQSGNPFGGGSSRARRQRRGEDVVHPLKVSLEDLYLGTTKKLSLSRKALCSKCNGKGSKSGASMKCGGCQGTGMKVSIRQFGPGMIQQMQHACHDCKGTGETINDRDRCPQCKGEKVVSEKKVLEVAVEKGMQHSQKITFSGQADEAPDTVTGDIVFVIQQKEHPKFKRKGEDLFVEHTLSLTEALCGFQFVLTHLDTRQLLIKSNPGEVVKPDSYRAISDEGMPIHQRPFMKGKLYIHFTVEFPESLSPDQTKAIEAVLPKPSKAALSDMEIDECEETTLHDVNIEDEMRRKAQAQREAYDDDEEDGPGGAQRVQCAQQ

SEQ ID NO: 14182 - protein, 420 aa, Eutrema parvulum
MFGRGHSRKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGHPFGGGSSRGRRQRRGEDVVHPLKVSLEDLYLGTTKKLSLSRKALCSKCNGKGSKSGASMKCGGCQGTGMKVSIRQFGPGMIQQMQHACHDCKGTGETISDRDRCPQCKGEKVVSEKKVLEVAVEKGMQHGQKITFSGQADEAPDTVTGDIVFVIQQKEHPKFKRKGEDLFVEHTLSLTEALCGFQFVLTHLDTRQLLIKSNHGEVVKPDSYRAISDEGMPIYQRPFMKGKLYIHFTVEFPESLSLDQTKAIEAVLPKPTKTTLSDMEIEECEETTLHDVNIEDEMRRKAQAQREAYDDDDEEGPGGAQRVQCAQQ

SEQ ID NO: 14183 - protein, 420 aa, Arabidopsis lyrata
MFGRGPSRKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGNPFGGGSSRGRRQRRGEDVVHPLKVSLEDVYLGTTKKLSLSRKVLCSKCNGKGSKSGASMKCGGCQGSGMKVSIRQVGPGMIQQMQHACNDCKGTGETINDRDRCPQCKAEKVVSEKKVLEVNVEKGMQHNQKITFNGQADEAPDTVTGDIVFVIQQKEHPKFKRKGDDLFVEHTLSLTEALCGFQFVLTHLDKRQLLIKSSPGEVVKPDSYKAISDEGMPIYQRPFMKGKLYIHFTVEFPESLSPDQTKAIEAVLPKPTKAAISDMEIDECEETTLHDVNIEDEMKRKAQAQREAYDDDEDEHPGGAQRVQCAQQ

SEQ ID NO: 14184 - protein, 422 aa, Brassica rapa
MFRRGPSSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGSPFGGGSSRGRRQRRGEDVVHPLKVSLEDLYLGTTKKLSLSRNALCSKCNGKGSKSGASSTCSGCQGSGMKVSIRQLGPGMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTHLDKRQLLIKSSPGEVVKPDSYRAITDEGMPMHQRPFMKGKLYIHFTVDFPDSLSPDQTKAIEAVLPKPKADLSDMEIDECEETTLHEVNIEDEMRRKAQAQREAYDDDDDDEEGPGGAQRVQCAQQ

SEQ ID NO: 14185 - protein, 422 aa, Brassica rapa
MFRRGPPSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGSPFGGGSSRGRRQRRGEDVVHPLKVSLEDLYLGTTKKLSLSRNALCSKCNGKGSKSGASSTCSGCQGSGMKVSIRQLGPGMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTHLDKRQLLIKSSPGEVVKPDSYRAITDEGMPMHQRPFMKGKLYIHFTVDFPDSLSPDQTKAIEAVLPKPKADLSDMEIDECEETTLHEVNIEDEMRRKAQAQREAYDDDDDDEEGPGGAQRVQCAQQ

SEQ ID NO: 14186 - protein, 422 aa, Brassica napus
MFRRGPPSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGSPFGGGSSRGRRQRRGEDVVHPLKVSLEDLYLGTTKKLSLSRNALCSKCNGKGSKSGASSTCSGCQGSGMKVSIRQLGPGMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTHLDKRQLLIKSSPGEVVKPDSYRAITDEGMPMHQRPFMKGKLYIHFTVDFPDSLSPDQTKAIEAVLPKPKADLSDMEIDECEETTLHDVNIGDEMRRKAQAQREAYDDDDDDEEGPGGAQRVQCAQQ

SEQ ID NO: 14187 - protein, 422 aa, Brassica napus
MFRRGPSSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGSPFGGGSSRGRRQRRGEDVVHPLKVSLEDLYLGTTKKLSLSRNALCSKCNGKGSKSGASSTCSGCQGSGMKVSIRQLGPGMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTHLDKRQLLIKSSPGEVAKPDSYRAITDEGMPMHQRPFMKGKLYIHFTVDFPDSLSPDQTKAIEAVLPKPKADLSDMEIDECEETTLHEVNIEDEMRRKAQAQREAYDDDDDDEEGPGGAQRVQCAQQ

SEQ ID NO: 14188 - protein, 423 aa, Unknown
  Sequence found in Organisms: Brassica napus, Brassica oleracea
MFRRGPSSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGHPFGGGSSRGRRQRRGEDVVHPLKVSLEDLYLGTTKKLSLSRKALCSKCNGKGSKSGASMTCGGCQGSGMKVSIRQIGPGMIQQMQHPCHDCKGTGETINDRDRCPQCKGEKVVSEKKVLEVAVEKGMQHSQKITFRGQADEAPDTVTGDIVFVIQQKEHSTFKRKGDDLFVEHTLSLTEALCGFQFVLTHLDTRQLLIKSNPGEVVKPDSYRAISDEGMPIHQRPFMKGKLYIHFTVEFPDSLNPDQTKAIEAVLPKRANATLSDMEIDECEETTLHDVNIEDEMRRKAQAQREAYDDDDDDEEGPGGAQRVQCAQQ

SEQ ID NO: 14189 - protein, 423 aa, Brassica rapa
MFRRGPSSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGHPFGGGSSRGRRQRRGEDVVHPLKVSLEDLYLGTTKKLSLSRKALCSKCNGKGSKSGASMTCGGCQGSGMKVSIRQIGPGMIQQMQHPCHDCKGTGETINDRDRCPQCKGEKVVSEKKVLEVAVEKGMQHSQKITFRGQADEAPDTVTGDIVFVIQQKEHSTFKRKGDDLFVEHTLSLTEALCGFQFVLTHLDTRQLLIKSSPGEVVKPDSYRAISDEGMPIHQRPFMKGKLYIHFTVEFPDSLSPDQTKAIEAVLPRPANATLSDMEIDECEETTLHDVNIEDEMRRKAQAQREAYDDDDDDEEGPGGAQRVQCAQQ

SEQ ID NO: 14190 - protein, 423 aa, Brassica napus
MFRRGPSSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGHPFGGGSSRGRRQRRGEDVVHPLKVSLEDLYLGTTKKLSLSRKALCSKCNGKGSKSGASMTCGGCQGSGMKVSIRQIGPGMIQQMQHPCHDCKGTGETINDRDRCPQCKGEKVVSEKKVLEVAVEKGMQHSQKITFRGQADEAPDTVTGDIVFVIQQKEHSTFKRKGDDLFVEHTLSLTEALCGFQFVLTHLDTRQLLIKSNPGEVVKPDSYRAISDEGMPIHQRPFMKGKLYIHFTVEFPDSLSLDQTKAIEAVLPRPANATLSDMEIDECEETTLHDVNIEDEMRRKAQAQREAYDDDDDDEEGPGGAQRVQCAQQ

SEQ ID NO: 14191 - protein, 422 aa, Brassica oleracea
  misc_feature (364)..(364): Xaa can be any naturally occurring amino acid
MFRRGPSSKSDNTKFYEILGVPKTASPEDLKKAYKKAAIKNHPDKGGDPEKFKEIAQAYEVLSDPEKREIYNQYGEDALKEGMGGGGGGHDPFDIFSSFFGGGGSPFGGGSSRGRRQRRGEDVVHPLKVSLEDLYLGTTKKLSLSRNTLCSKCNGKGSKSGASSTCSGCQGSGMKVSIRQLGPGMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTHLDKRQLLIKSSPGEVVKPDSYRAITDEGMPMHQRPFMKGKLYIHFTVDFPDSLSPDQTKAIEAVLPKAXADLSDMEIDECEETTLHEVNIEDEMRRKAQAQREAYDDDDDDDEEGPGGAQRVQCAQQ

SEQ ID NO: 14192 - protein, 421 aa, Brassica napus
MFRRGPSSKSDNTKFYEILGVPKTASPEDLKKAYKKAAIKNHPDKGGDPEKFKEIAQAYEVLSDPEKREIYDQYGEDALKEGMGGGGGGHDPFDIFSSFFGGGGSPFGGGSSRGRRQRRGEDVVHPLKVSLEDLYLGTTKKLSLSRNTLCSKCNGKGSKSGASSTCSGCQGSGMKVSIRQLGPGMIQQMQHPCHDCKGTGETINDRDRCPQCKGDKVVSEKKVLEVAVEKGMQHSQKITFSGQADEAPDTVTGDIVFVIQQKEHPKFKRKGDDLFVEHTLSLTEALCGFQFVLTHLDKRQLLIKSSPGEVVKPDSYRAITDEGMPVHQRPFMKGKLYIHFTVDFPDSLSPDQTKAIEAVLPKPKADLSDMETDECEETTLHEVNIEDEMRRKAQAQREAYDDDDDDEEGPGGPQRVQCAQQ

SEQ ID NO: 14193 - protein, 419 aa, Arabidopsis thaliana
MFGRGPSRKSDNTKFYEILGVPKTAAPEDLKKAYKKAAIKNHPDKGGDPEKFKELAQAYEVLSDPEKREIYDQYGEDALKEGMGGGGGGHDPFDIFSSFFGSGGHPFGSHSRGRRQRRGEDVVHPLKVSLEDVYLGTTKKLSLSRKALCSKCNGKGSKSGASMKCGGCQGSGMKISIRQFGPGMMQQVQHACNDCKGTGETINDRDRCPQCKGEKVVSEKKVLEVNVEKGMQHNQKITFSGQADEAPDTVTGDIVFVIQQKEHPKFKRKGEDLFVEHTISLTEALCGFQFVLTHLDKRQLLIKSKPGEVVKPDSYKAISDEGMPIYQRPFMKGKLYIHFTVEFPESLSPDQTKAIEAVLPKPTKAAISDMEIDDCEETTLHDVNIEDEMKRKAQAQREAYDDDEEDHPGGAQRVQCAQQ

SEQ ID NO: 14194 - protein, 422 aa, Raphanus sativus
  misc_feature (386)..(386): Xaa can be any naturally occurring amino acid
MFRRGPSSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGGHPFGGGSSRGRRQRRGEDVVHPLKVSLEDLYLGTTKKLSLSRKALCSKCNGKGSKSGASMTCGGCQGSGMKVSIRQIGPGMIQQMQHPCHDCKGTGETINDRDRCPQCKGEKVVSEKKVLEVAVEKGMQHSQKITFDGQADEAPDTVTGDIVFVIQQKEHPKFKRKGEDLFVEHTLSLTEALCGFQFVLTHLDKRQLLIKSSPGEVVKPDSYRAISDEGMPMYQRPFMKGKLYIHFTVEFPESLTLDQTKAIEAVLPKPKAALSDMEIDECEETTLHDVXMEDEMRRKAQAQREAYDDDDDEEGPGGAQRVQCAQQ

SEQ ID NO: 14195 - protein, 421 aa, Raphanus sativus
  misc_feature (180)..(180): Xaa can be any naturally occurring amino acid
  misc_feature (183)..(183): Xaa can be any naturally occurring amino acid
MFRRGPSSKSDNTKFYEILGVPKTASPEDLKKAYKKAAIKNHPDKGGDPEKFKELAQAYEVLSDPEKREIYDQYGEDALKEGMGGGGGGHDPFDIFSSFFGGGGGHPFGGGSSRGRRQRRGEDVVHPLKVSLEDLYLGTTKKLSLSRKALCSKCNGKGSKSGASMTCGGCQGSGMKVSIXQLXPGMIQQMQHPCHDCKGTGETINDRDRCPQCKGEKVVSEKKVLEAAVEKGMQHSQKITFDGQADEAPDTVTGDIVFVIQQKDHPKFKRKGEDLFVEHTLSLTEALCGFQFVLTHLDKRQLLIKSGPGEVVKPDSYRAISDEGMPMYQRPFMKGKLYIHFTVEFPESLTPDQTKAIEAVLPKPKAALSDMEIDECEETTLHDVNMEDEMRRKAQAQREAYDDDDDEEGPGGAQRVQCAQQ

SEQ ID NO: 14196 - protein, 420 aa, Malus domestica
MFGRAPKKSDNTRYYEILGVSKSASPDDLKKAYKKAAIKNHPDKGGDPEKFKELAQAYEVLSDPEKREIYDQYGEDALKEGMGGGGGGGHDPFDIFSSFFGGSPFGGGGSSRGRRQRRGEDVVHALKVSLEDLYLGTSKKLSLSRNVLCSKCNGKGSKSGASLKCSGCQGSGMKVSIRHLGPSMIQQMQHACNECKGTGETISDRDRCTQCKGEKVVQEKKVLEVHVEKGMQNGQKITFPGEADEAPETVTGDIVFVIQQKEHPKFKRKGEDLFVEHTLSLTEALCGFQFVLTHLDGRQLLIKSNPGEVVKPDSFKAINDEGMPMYQRPFMKGKLYIHFNVEFPESLSPEQVKALEAALPGKPSASQLTDMEVDECEETTLHDVNMEEEMRRKQQQAQQEAYDEDDDMPGGAQRVQCAQQ

SEQ ID NO: 14197 - protein, 417 aa, Quercus alba
MFGRAPKKSDNTRYYEILGVSKNASQDDLKKAYKKAAIKNHPDKGGDPEKFKELAQAYEVLSDPEKREIYDQYGEDALKEGMGGGGGGHDPFDIFSSFFGGSPFGGGGSSRGRRQRRGEDVVHPLKVTLEDLYLGTAKKLSLSRNVICSKCNGKGSKSGASMKCAGCQGTGMKVSIRHLGPSMIQQMQHACNECKGTGETISDKDRCPQCKGEKVVQEKKVLEVIVEKGMQNGQKITFPGEADEAPDTVTGDIVFVLQQKEHPKFKRKGDDLFVEHTLSLTEALCGFQFVLTHLDGRPLLIKTHPGEVVKPDSFKAINDEGMPMYQRPFMKGKLYIHFTVEFPDSLSPEQVTALEAVLPPKSSTQLTDMELDECEETTLHDVNIEDEMRRKQHAQAEAYDEDEDMHGGAQRVQCAQQ

SEQ ID NO: 14198 - protein, 420 aa, Malus domestica
MFGRAPKKSDNTRYYEILGVSQSASSDDLKKAYKKAAIKNHPDKGGDPEKFKELAHAYEVLSDPEKREIYDQYGEDALKEGMGGGGGGGHDPFDIFSSFFGGSPFGGGGSSRGRRQRRGEDVVHALKVSLEDLYLGTSKKLSLSRNVLCSKCNGKGSKSGASLKCSGCQGTGMKVSIRHLGPSMIQQMQHACNECKGTGETISDRDRCTQCKGEKVVQEKKVLEVHVEKGMQNGQKITFPGEADEAPETVTGDIVFVIQQKEHPKFKRKGEDLFVEHTLPLTEALCGFQFVLTHLDGRQLLIKSNPGEVVKPDSFKAINDEGMPMYQRPFMKGKLYIHFNVEFPESLNPEQVKALEAALPGKPSASQLTDMEVDECEETTLHDVNMEEEMRRKQLQAQQEAYDEDDDMPGGAQRVQCAQQ

SEQ ID NO: 14199 - protein, 417 aa, Castanea mollissima
MFGRAPKKSDNTRYYEILGVSKNASQDDLKKAYKKAAIKNHPDKGGDPEKFKELAQAYEVLSDPEKREIYDQYGEDALKEGMGGGGGGHDPFDIFSSFFGGSPFGGGGSSRGRRQRRGEDVVHPLKVTLEDLYLGTAKKLSLSRNVICSKCNGKGSKSGASMKCAGCQGTGMKVSIRHLGPSMIQQMQHACNECKGTGETISDKDRCPQCKGEKVVQEKKVLEVIVEKGMQNGQKITFPGEADEAPDTVTGDIVFVLQQKEHPKFKRKGDDLFVEHTLSLTEALCGFQFVLTHLDSRQLLIKTNPGEVVKPDSFKAINDEGMPMYQRPFMKGKLYIHFAVEFPDSLSPEQVAALEAVLPPKSSTQLTDMELDECEETTLHDVNIEDEMRRKQHAQAEAYDEDEDMHGGAQRVQCAQQ

SEQ ID NO: 14200 - protein, 416 aa, Trigonella foenum-graecum
MFGRAPKKSDSTRYYEILGVSKTASQDDLKKAYKKAAIKNHPDKGGDPEKFKELAQAYEVLSDPEKREIYDTYGEDALKEGMGGGGGGGHDPFDIFSSFFGGGGGGSSRGRRQRRGEDVVHPLKVSLEDLYLGTSKKLSLSRNVLCSKCSGKGSKSGASTKCAGCQGTGMKVSIRHLGPSMIQQMQHPCNECRGTGETINDKDRCPQCKGDKVVQEKKVLEVHVEKGMQNSQKITFPGEADEAPDTVTGDIVFVLQQKEHPKFKRKSEDLFVEHTLSLTEALCGFQFVLTHLDGRQLLIKSNPGEVVKPNSYKAINDEGMPMYQRPFMKGKLYIHFTVEFPDSLSLDQVKGLEAVLPAKPSSQLTDMEIDECEETTLHDVNMEEETRRKQQQQQQEAYDEDDDMPGGAQRVQCAQQ

SEQ ID NO: 14201 - protein, 416 aa, Medicago truncatula
MFGRAPKKSDSTRYYEILGVSKTASQDDLKKAYKKAAIKNHPDKGGDPEKFKELAQAYEVLSDPEKREIYDTYGEDALKEGMGGGGGGGHDPFDIFSSFFGGGGGGSSRGRRQRRGEDVVHPLKVSLEDLYLGTSKKLSLSRNVLCSKCSGKGSKSGASMKCAGCQGTGMKVSIRHLGPSMIQQMQHPCNECKGTGETINDKDRCPQCKGEKVVQEKKVLEVHVEKGMQNSQKITFPGEADEAPDTVTGDIVFVLQQKEHPKFKRKSEDLFVEHTLSLTEALCGFQFVLTHLDGRQLLIKSNPGEVVKPDSYKAINDEGMPMYQRPFMKGKLYIHFTVEFPDTLSLDQVKGLEAVLPAKPSSQLTDMEIDECEETTLHDVNMEEENRRKQQQQQQEAYDEDDDMPGGAQRVQCAQQ

SEQ ID NO: 14202 - protein, 417 aa, Glycine max
MFGRAPKKSDNTRYYEILGVSKNASQDDLKKAYKKAAIKNHPDKGGDPEKFKELAQAYEVLSDPEKREIYDQYGEDALKEGMGGGGGHDPFDIFSSFFGGGSPFGSGGSSRGRRQRRGEDVVHPLKVSLEDLYLGTSKKLSLSRNVICSKCSGKGSKSGASMKCAGCQGTGMKVSIRHLGPSMIQQMQHACNECKGTGETINDRDRCPQCKGEKVVQEKKVLEVIVEKGMQNGQKITFPGEADEAPDTITGDIVFVLQQKEHPKFKRKAEDLFVEHTLSLTEALCGFQFVLTHLDSRQLLIKSNPGEVVKPDSYKAINDEGMPMYQRPFMKGKLYIHFTVEFPDSLNPDQVKALEAVLPPKPSSQLTDMELDECEETTLHDVNMEEETRRKQQQAQEAYDEDDDMPGGAQRVQCAQQ

SEQ ID NO: 14203 - protein, 417 aa, Catharanthus roseus
MFGRAPKKSDNTKYYEILGVPKNATPEDLKKAYKKAAIKNHPDKGGDPEKFKELAQAYEVLSDPEKREIYDQYGEDALKEGMGGGGGMHDPFDIFSSFFGGGAFGGGSSRGRRQRRGEDVVHPLKVSLEDLYSGTTKKLSLSRNVICSKCSGKGSKSGASSKCSGCQGTGMKVTIRQLGPGMIQQMQHACNECKGTGETISDRDRCPQCKGEKVVSEKKVLEVVVEKGMQNGQKITFPGEADEAPDTITGDIVFVLQQKEHPKFKRKHGDLFVEHTLSLTEALCGFQFILTHLDGRQLLIKSKPGEVIKPDQYKAIDDEGMPLYQRPFMRGKLYIHFTVEFPDSLSPDQVKALEAILPPRPQSQLTDMELDECEETTLHDVNIEEEMRRKQAQAQQEAYDEDEDMHGGAQRVQCAQQ

SEQ ID NO: 14204 - protein, 417 aa, Arachis hypogaea
MFGRAPKKSDNTRYYEILGVSKNASQDDLKKAYKKAAIKNHPDKGGDPEKFKELAQAYEVLSDPEKREIYDQYGEDALKEGMGGGGGGHDPFDIFQSFFGGSPFGGGGSSRGRRQRRGEDVVHPLKVSLEDLYLGTSKKLSLSRNVLCSKCNGKGSKSGNSTKCAGCQGTGMKVSIRHLGPSMIQQMQHPCNECKGTGETISDRDRCPQCKGEKVVQEKKVLEVHVEKGMQNGQKITFPGEADEAPDTITGDIVFVLQQKEHPKFKRKAEDLFVEHTLSLTESLCGFQFVLTHLDGRQLLIKSNPGEVVKPDSFKAINDEGMPIYQRPFMKGKLYIHFTVEFPESLNPDQVKALEAVLPSRPSSQLTDMELDECEETTLHDVNMEEESRRKAQAQQEAYEEDDDMPGGAQRVQCAQQ

SEQ ID NO: 14205 - protein, 419 aa, Ambrosia trifida
MFGRAPKKSDNTKYYEILGVPKTASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGEDIFVEHTLSLTEALCGFQFILTHLDNRQLLIKSQPGEVVKPDSFKAINDEGMPMYQRPFMKGKLYIHFTVEFPESLSPEQCKALEAVLPPKPSMQMSDMELDECEETTLHDVNIEEEMRRKQQAAHEAYDEDDDDMHGGAQRVQCAQQ

SEQ ID NO: 14206 - protein, 417 aa, Glycine max
MFGRAPKKSDNTRYYEILGVSKNASQDDLKKAYKKAAIKNHPDKGGDPEKFKELAQAYEVLSDPEKREIYDQYGEDALKEGMGGGGGHDPFDIFSSFFGGGSPFGSGGSSRGRRQRRGEDVVHPLKVSLEDLYLGTSKKLSLSRNVICSKCTGKGSKSGASMKCAGCQGTGMKVSIRHLGPSMIQQMQHACNECKGTGETINDRDRCPQCKGEKVVQEKKVLEVIVEKGMQNGQKITFPGEADEAPDTITGDIVFVLQQKEHPKFKRKAEDLFVEHILSLTEALCGFQFVLTHLDGRQLLIKSNPGEVVKPDSYKAINDEGMPMYQRSFMKGKLYIHFTVEFPDSLNPDQVKALEAVLPPKPSSQLTDMELDECEETTLHDVNMEEETRRKQQQAQEAYDEDDDMPGGAQRVQCAQQ

SEQ ID NO: 14207 - protein, 417 aa, Amsonia hubrichtii
MFGRAPKKSDNTRYYEILGVPKNASPEDLKKAYKKAAIKNHPDKGGDPEKFKELAQAYEVLSDPEKREIYDQYGEDALKEGMGGGGGMHDPFDIFQSFFGGSPFGGGSSRGRRQRRGEDVVHPLKVSLEDLFSGTTKKLSLSRNVICTKCSGKGSKSGASTKCSGCQGTGMKVTIRQLGPGMIQQMQHPCSECKGTGETISDRDRCPQCKGDKVVPEKKVLEVVVEKGMHNGQKITFPGEADEAPDTVTGDIVFVLQQKEHPKFKRKSDDLFVEHTLSLTEALCGFQFILTHLDGRQLLIKSKPGEVIKPDQYKAIDDEGMPMYQRPFMRGKLYIHFTVEFPDSLSPEQVKALEEILPPRPVSQLTDMELDECEETTLHDVNIEEEMRRKQAQAQQEAYDEDDDMHGGAQRVQCAQQ

SEQ ID NO: 14208 - protein, 419 aa, Cajanus cajan
MFGRAPKKSDNTRYYEILGVAKNASQDDLKKAYKKAAIKNHPDKGGDPEKFKELAQAYEVLSDPEKREIYDQYGEDALKEGMGGGGGGHDPFDIFSSFFGGGSPFGSGGSSRGRRQRRGEDVVHPLKVSLEDLYLGTSKKLSLSRNVICSKCSGKGSKSGASMKCAGCQGTGMKVSIRHLGPSMIQQMQHACNECKGTGETINDRDRCPQCKGEKVVQEKKVLEVHVEKGMQNGQKITFPGEADEAPDTITGDIVFVLQQKEHPKFRRKSEDLFVEHTLSLTEALCGFQFVLTHLDGRQLLIKSNPGEVVKPDAYKAINDEGMPMYQRPFMKGKLYIHFTVEFPDFLNADQVKALEAVLPPKPSSQLTDMELDECEETTLHDVNMEEETRRKQQQAAQEAYDEDDEMPGGAQRVQCAQQ

SEQ ID NO: 14209 - protein, 419 aa, Ambrosia trifida
MFGRAPKKSDNTKYYEILGVPKTASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGEDILVEHTLSLTEALCGFQFILTHLDNRQLLIKSQPGEVVKPDSFKAINDEGMPMYQRPFMKGKLYIHFTVEFPESLSPEQCKALEAVLPPKPSMQMTDMELDECEETTLHDVNIEEEMRRKQQAAQEAYDEDDDDMHGGAQRVQCAQQ

SEQ ID NO: 14210 - protein, 419 aa, Ambrosia trifida
MFGRAPKKSDNTKYYEILGVPKTASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDSFKAINDEGMPMYQRPFMKGKLYIHFTVEFPESLSPEQCKALEAVLPPKPSMQMTDMELDECEETTLHDVNIEEEMRRKQQAAHEAYDEDDDDMPGGAQRVQCAQQ

SEQ ID NO: 14211 - protein, 417 aa, Tripterygium wilfordii
MFGRAPKKSDNTRYYEVLGVPKNAGQDDLKKAYKKAAIKNHPDKGGDPEKFKELAHAYEVLSDPEKREIYDQYGEDALKEGMGGGGGGHDPFDIFSSFFGGSPFGGGSSRGRRQRRGEDVVHPLKVSLEDLYLGTSKKLSLSRNVICSKCNGKGSKSGASMTCAGCQGTGMKVSIRHLGPSMIQQMQHPCNECKGTGETISDKDRCPQCKGEKVVQEKKVLEVIVEKGMQNGQKITFPGEADEAPDTVTGDIVFVLQQKEHPRFKRKGSDLFVEHTLSLTEALCGFHFVLTHLDGRQLLIKSNPGEVVKPDSFKAINDEGMPVYQRPFMKGKLYIHFTVEFPDSVAPDQVKALEAILPSRPTSQLTDMELDECEETTLHDVNIEEEMRRKQQQAQQEAYDEDEDMPGGAQRVQCAQQ

SEQ ID NO: 14212 - protein, 416 aa, Eucalyptus grandis
MFGRAPKKSDNTRYYEVLGVSKNASQEDLKKAYRKAAIKNHPDKGGDPEKFKELAQAYEVLSDPEKREIYDQYGEDALKEGMGGGGGGHDPFDIFSSFFGGSGFGGGSSRGRRQRRGEDVVHPLKASLEDLYLGTTKKLSLSRNVICVKCNGKGSKSGASMTCPGCQGTGMKVTIRQLGPSMIQQMQQACNECKGTGETINEKDRCPQCKGDKVVPEKKVLEVVVEKGMQNGQKITFPGEADEAPDTVTGDIVFILQQKEHPKFKRKGDDLFVEHTLSLTEALCGFQFVLTHLDGRQLLIKSNPGEVVKPDSFKAINDEGMPMYQRPFMKGKLYIHFTVDFPESLSPEQVEALQSVLPQKPASQLTEMELDECEETTLHDVNIEEEMRRKQQAQAEAYDEDDDMPSGAQRVQCAQQ

SEQ ID NO: 14213 - protein, 418 aa, Euphorbia peplus
MFGRSAPKKSDNSKYYEILGVSQTASPDDLKKAYKKAAIKNHPDKGGDPEKFKELAQAYEVLSDPEKREIYDQYGEDALKEGMGGGGGGHNPFDIFESFFGGSPFGGGSSRGRRQRRGEDVVHPLKVSLEDLYLGTTKKLSLSRNVICSKCSGKGSKSGASMKCGGCQGTGMKVSIRQLGPSMIQQMQHACNECKGTGESINDKDRCTQCKGEKVVAEKKVLEVVVEKGMQHGQKITFPGEADEAPDTVTGDIVFVLQQKDHPKFKRKGEDLIVEHNLSLTESLCGFHFVLTHLDGRQLLIKSNPGEVVKPDSFKGINDEGMPMYQRPFMKGKLYIHFNVEFPDSLTPDQVKALEAILPARPSSQLTDMELDECEETTLHDVNMEEEMRRKQQQAQQEAYDEDDDMPGGAQRVQCAQQ

SEQ ID NO: 14214 - protein, 416 aa, Citrus sinensis
MFGRAPKKSNNTRYYEILGVSKNASAEDLKKAYKKAAIKNHPDKGGDPEKFKELAQAYEVLSDPEKREIYDQYGEDALKEGMGGGAGAHDPFDIFSSFFGGSPFGGGSSRGRRQRRGEDVVHPLKVSLEDLYLGTSKKLSLSRNVICSKCSGKGSKSGASMKCSGCQGTGMKVSIRHLGPSMIQQMQHPCNECKGTGETINDKDRCPQCKGDKVVQEKKVLEVIVEKGMQNGQKITFPGEADEAPDTVTGDIVFVLQQKEHPKFKRKGEDLFYEHTLSLTEALCGFQFALTHLDGRQLLIKSNPGEVVKPDSYKAINEEGMPLYQRPFMKGKLYIHFTVEFPDSLTPDQVKALEAILPSRPLSGMTDMELDECEETTLHDVNIEEEMRRKQAHAQEAYEEDEDMPGGAQRVQCAQQ

SEQ ID NO: 14215 - protein, 418 aa, Trigonella foenum-graecum
MFGRGPKKSDNSKYYEILGVSKSASPDDLKKAYKKAAIKNHPDKGGDPEKFKELAQAYEVLSDPEKREIYDQYGEDALKEGMGGGGGGHDPFDIFSSFFGGGGFPGGGSSRGRRQRRGEDVVHPLKVSLEDLYLGTSKKLSLSRNVLCSKCNGKGSKSGASMTCAGCQGTGMKISMRHLGANMIQQMQHPCNECKGTGETISDKDRCPQCKGEKVVQQKKVLEVHVEKGMQNGQKITFPGEADEAPDTVTGDIVFVLQQKEHPKFKRKGEDLFVEHTLSLTEALCGFQFALTHLDSRQLLIKSNSGEVVKPDSYKAINDEGMPMYQRPFMKGKLYIHFTVEFPESLTLDQVKALETILPARPVSQLTDMELDECEETTLHDVNIEEEGRRRQQAQQEAYDDDDDMPGGGAQRVQCAQQ

SEQ ID NO: 14216 - protein, 419 aa, Mesembryanthemum crystallinum
MFGRAPKKSDNTKYYEVLGVPKTAAPEDLKKAYKKAAIKNHPDKGGDPEKFKELAHAYEVLSDPEKREIYDQYGEDALKEGMGGGGGMHDPFDIFSSFFGGSPFGGGGSSRGRRQRRGEDVIHPLKVSLDDLYNGMTKKLSLSRNALCSKCKGKGSKSGASMNCSGCQGTGMKVSIRHLGPSMIQQMQHPCNECKGTGETINDKDRCPQCKGEKVVQEKKVLEVVVEKGMQHGQKITFPGEADEAPDTVTGDIVFVVQQKEHPKFKRKGEDLFYEHTLSLTESLCGFRFVLTHLDGRQLLVKSNPGEVIKPDQTKAIDDEGMPIYQRPFMKGKLYIHFTVEFPDTLGPDQWKALEAVLPPRPSLQLTDMELDECEETILHDVNIEEDMRRKRAQAQQEAYDEDDESYGGGAQRVQCAQQ

SEQ ID NO: 14217 - protein, 419 aa, Petunia hybrida
MFGRAPKKSDNTKYYEILGVPKTASQEDLKKAYRKAAIKNHPDKGGDPEKFKELAQAYEVLSDPEKREIYDQYGEDALKEGMGGGGGGHDPFDIFSQFFGGGSPFGGGGSSRGRRQRRGEDVVHPLKVSLEDLYNGTSKKLSLSRNVLCAKCKGKGSKSGASMKCSGCQGSGMKVSIRQLGPSMIQQMQHPCNECKGTGETINDKDRCPQCKGEKVAQEKKVLEVHVEKGMQNGQKITFPGEADEAPDTVTGDIVFVLQQKEHPKFKRKGDDLFVEHTLTLTEALCGFQFILTHLDNRQLLIKSQPGEVVKPDQFKAINDEGMPMYQRPFMKGKLYIHFTVDFPDSLTPEQSKNLEAVLPPRPKLQVSDMELDECEETTLHDVNIEDEMRRKQQAAQEAYDEDDDMHGGGAQRVQCAQQ

SEQ ID NO: 14218 - protein, 418 aa, Prunus persica
MFGRAPKKSDNTRYYEILGVSQNASHDDLKKAYKKAAIKNHPDKGGDPEKFKELAQAYDVLSDPEKREIYDQYGEDALKEGMGGGGGGHDPFDIFSSFFGGSPFGGGGSSRGRRQRRGEDVVHSLKVSLEDIYLGTSKKLSLSRNVLCSKCNGKGSKSGASLKCAGCQGTGMKVTIRHLGPSMIQQMQHACNECKGTGETISDKDRCTQCKGEKVVQEKKVLEVIVEKGMQSGQKISFPGEADEAPETVTGDIVFIIHQKEHPKFKRKGEDLFVEHSLSLTEALCGFQFVLTHLDGRQLLIKSNPGEVVKPDSFKAINDEGMPLYQRPFMKGKLYIHFNVDFPESLNPEQVKALEAILPSKPGASQLTDMEVDECEETTLHDVNMEEEMRRKQQAQAEAYDEDDDMPGGAQRVQCAQQ

SEQ ID NO: 14219 - protein, 413 aa, Cucumis melo
MFGRAPKKSDNTRYYEILGVSKNASQDDLKKAYKKAAIKNHPDKGGDPEKFKELAQAYEVLSDPEKREIYDQYGEDALKEGMGGGGGHDPFDIFQSFFGGSPFGGGSSRGRRQRRGEDVVHPLKVSLEDLYLGTSKKLSLSRNVICSKCNGKGSKSGASMSCSGCQGTGMKVTIRHLGPSMIQQMQHPCNECKGTGETISDKDRCSQCKGEKVVQEKKVLEVIVEKGMQNGQKITFPGEADEAPDTVTGDIVFVLQQKEHPKFKRKGEDLFVEHTLSLTEALCGFQFVLTHLDGRQLLIKTNPGEVVKPDSFKAINDEGMPVYQRPFMKGKLYIHFSVDFPDSLSPEQIKALETVLPSKPSSQLTDMELDECEETSMHDVNIEEEMRRKQQAEAYEEDEDMHGGAQRVQCAQQ

SEQ ID NO: 14220 - protein, 418 aa, Arachis hypogaea
MFGRAPKKSDNTKYYEILGVSKEASQDDLKKAYKKAAIKNHPDKGGDPEKFKELAHAYEVLSDPEKREIYDQYGEDALKEGMGGGGGGHDPFDIFQSFFGGSPFGSGGGGSRGRRQRRGEDVVHPLKVSLEDLYLGTSKKLSLSRNVLCSKCNGKGSKSGASMTCAGCQGTGMKVSIRHLGPSMIQQMQHPCNECKGTGETINEKDRCPQCKGEKVVQEKKVLEVHVEKGMQNGQKITFPGEADEAPDTVTGDIVFVLQQKEHPKFKRRDEDLFVEHSLSLTEALCGFKFVLTHLDGRQLLIKSNPGEVIKPDSYKAINDEGMPMYQRPFMKGKLYIHFSVEFPESLIPDQVKALEAVLPPKPTSQLTDMELDECEETTLHDVNMEEEMRRRQQAQQEAYDEDDDMHGGHQRVQCAQQ

SEQ ID NO: 14221 - protein, 421 aa, Helianthus annuus
MFGRAPKKSDNTKYYEILGVPKTASQDDLKKAYRKAAIKNHPDKGGDPEKFKELAQAYEVLSDPEKREIYDQYGEDALKEGMGGGGGGHDPFDIFQSFFGGGSPFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDSFKAINDEGMPMYQRPFMKGKLYIHFTVEFPESLSPEQCKALEAVLPPKPSMQMTDMELDECEETTLHDVNIEEEMRRKQQAAQEAYDEDDEDMHGGAQRVQCAQQ

SEQ ID NO: 14222 - protein, 121 aa, Fraxinus spp
MFGRAPKKSDNTKYYEILGVSKTASPDDLKKAYKKAAIKNHPDKGGDPEKFKELAHAYEVLSDPEKREIYDQYGEDALKEGWVGAVACTIHSTFSHPSLVEVHLEVVVVAAEEGGRGEERM

SEQ ID NO: 14223 - protein, 416 aa, Unknown
  Sequence found in Organisms: Citrus sinensis, Citrus clementina
MFGRAPKKSNNTRYYEILGVSKNASAEDLKKAYKKAAIKNHPDKGGDPEKFKELAQAYEVLSDPEKREIYDQYGEDALKEGMGGGAGAHDPFDIFSSFFGGSPFGGGSSRGRRQRRGEDVVHPLKVSLEDLYLGTSKKLSLSRNVICSKCSGKGSKSGASMKCSGCQGTGMKVSIRHLGPSMIQQMQHPCNECKGTGETINDKDRCPQCKGEKVVQEKKVLEVIVEKGMQNGQKITFPGEADEAPDTVTGDIVFVLQQKEHPKFKRKGEDLFYEHTLSLTEALCGFQFALTHLDGRQLLIKSNPGEVVKPDSYKAINEEGMPLYQRPFMKGKLYIHFTVEFPDSLTPDQVKALEAILPSRPLSGMTDMELDECEETTLHDVNIEEEMRRKQAHAQEAYEEDEDMPGGAQRVQCAQQ

SEQ ID NO: 14224 - protein, 417 aa, Tabernaemontana elegans
MFGRAPKKSDNTRYYEILGVPKNASPEDLKKAYKKAAIKNHPDKGGDPEKFKELAQAYDVLSDPEKREIYDQYGEDALKEGMGGGGGMHDPFDIFQSFFGGNPFGGGGSRGRRQRRGEDVVHPLKVSLEDLFGGTTKKLSLSRNVICSKCSGKGSKSGASMKCSGCQGTGMKVTIRQLGPGMIQQMQHPCNECKGTGETISDRDRCTQCKGEKVVPEKKVLEVVVEKGMHNGQKITFPGEADEAPDTVTGDIVFVLQQKEHPKFKRKHDDLFVEHTLSLTEALCGFQFILTHLDGRQLLIKSKPGEVIKPDQFKAIDDEGMPMYQRPFMRGKLYIHFTVEFPESLSPEQVKALEEILPPRPQSQLTDMELDECEETTLHDVNIEEEMRRKHAQAQQEAYDEDDDMHGGAQRVQCAQQ

SEQ ID NO: 14225 - protein, 417 aa, Vinca minor
MFGRAPKKSDNTKYYEILGVPKTASQEDLKKAYKKAAIKNHPDKGGDPEKFKELAHAYEVLSDPEKREIYDQYGEDALKEGMGSGGGMHDPFDIFQSFFGGSGFGGGSSRGRRQRRGEDVVHALKVSLEDLFNGTTKKLSLSRNVICSKCSGKGSKSGASHKCSGCQGTGMKVTIRQLGPGMIQQMQHPCNDCKGTGEMISDRDRCPQCKGEKFVPEKKVLEVVVEKGMHNSQKITFPGEADEAPDTVTGDIVFVLQQKEHPKFKRKHDDLFVEHTLSLTEALCGFQFILTHLDGRQLLIKSKPGEVIKPDQYKAIDDEGMPMYQRPFMRGKLYIHFTVEFPDSLSPDQVKALEVILPTRAQSQLADMELDECEETTLHDVNIEEEMRRKQAQAQQEAYDDDEDMHGGAQRVQCAQQ

SEQ ID NO: 14226 - protein, 413 aa, Cucumis sativus
MFGRAPKKSDSTRYYEILGVSKNASQDDLKKAYKKAAIKNHPDKGGDPEKFKELAQAYEVLSDPEKREIYDQYGEDALKEGMGGGGGHDPFDIFQSFFGGSPFGGGSSRGRRQRRGEDVVHPLKVSLEDLYLGTSKKLSLSRNVICSKCNGKGSKSGASMSCSGCQGTGMKVTIRHLGPSMIQQMQHPCNECKGTGETISDKDRCSQCKGEKVVQEKKVLEVIVEKGMQNGQKITFPGEADEAPDTVTGDIVFVLQQKEHPKFKRKGEDLFVEHTLSLTEALCGFQFALTHLDGRQLLIKTNPGEVVKPDSFKAINDEGMPVYQRPFMKGKLYIHFSVDFPDSLSPEQIKALEAVLPSKPSSQLTDMELDECEETSMHDVNIEEEMRRKQQAEAYEEDEDMHGGAQRVQCAQQ

SEQ ID NO: 14227 - protein, 419 aa, Capsicum annuum
MFGRAPKKSDNTKYYEILGVPKTAAPEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCPKCKGKGSKSGASMKCSGCQGSGMKVTIRQLGPSMIQQMQHPCNECKGTGEMINDKDRCGQCKGEKVVQEKKVLEVVVEKGMQNGQKITFPGEADEAPDTVTGDIVFVLQQKEHPKFKRKGDDLFVEHTLSLTEALCGFQFILTHLDNRQLIIKSQPGEVVKPDQFKAINDEGMPMYGRPFMRGKLYIHFTVEFPDTLSPDQCKNLEAVLPAKPKTQMTDMELDECEETTLHDVNIEEEMRRKQQQAQEAYDEDDEDMHGGAQRVQCAQQ

SEQ ID NO: 14228 - protein, 419 aa, Solanum phureja
MFGRAPKKSDNTKYYEILGVPKTAAPEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCSKCKGKGSKSGASMKCSGCQGSGMKVTIRQLGPSMIQQMQHPCNECKGTGEMINDKDRCGQCKGEKVVQEKKVLEVVVEKGMQNGQKITFPGEADEAPDTVTGDIVFVLQQKEHPKFKRKGDDLFVEHTLSLTEALCGFQFILTHLDNRQLIIKPQPGEVVKPDQFKAINDEGMPMYQRPFMRGKLYIHFTVEFPDTLSPEQCKNLEAVLPPKPKTQMTDMELDECEETTLHDVNIEEEMRRKQQQAQEAYDEDDEDMHGGAQRVQCAQQ

SEQ ID NO: 14229 - protein, 417 aa, Glycine max
MFGRAPKKSDSTRYYEILGVSKNASPDDLKKAYKKAAIKNHPDKGGDPEKFKELAQAYEVLSDPEKREIYDTYGEDALKEGMGGGGGGHDPFDIFSSFFGGSPFGSGGSSRGRRQRRGEDVVHPLKVSLEDLYLGTSKKLSLSRNVLCSKCNGKGSKSGASMTCAGCQGTGMKVSIRHLGPSMIQQMQHPCNECKGTGETINDRDRCQQCKGEKVVQEKKVLEVVVEKGMQNGQKITFPGEADEAPDTVTGDIVFVLQQKEHPKFKRKADDLFVEHTLSLTEALCGFQFVLTHLDSRQLLIKSNPGEVVKPESFKAINDEGMPNYQRHFLKGKLYIHFSVEFPDTLSLDQVKALEAVLPSKPTSQLSDMELDECEETTLHDVNMEEETRRRQQAQQEAYDEDEDMHGGAQRVQCAQQ

SEQ ID NO: 14230 - protein, 420 aa, Lactuca sativa
MFGRQPKKSDNTKYYEILGVPKSASQDDLKKAYRKAAIKNHPDKGGDPEKFKELAQAYEVLSDPEKREIYDQYGEDALKEGMGGGGGGHDPFDIFQSFFGGGNPFGGAGGSSRGRRQRRGEDVIHPLKVSLEDLYNGTSKKLSLSRNVLCSKCKGKGSKSGASMKCAGCQGSGMKVSIRHLGPSMIQQMQHPCNECKGTGETINDKDRCPQCKGEKVVQEKKVLEVHVEKGMQNSQKITFPGEADEAPDTVTGDIVFVLQQKEHPKFKRKGDDLFVEHTLSLTEALCGFQFILTHLDSRQLLIKSEPGEVVKPDQFKAINDEGMPMYQRPFMKGKLYIHFTVEFPESLSPEQCKALEGVLPPKPSMQMTDMELDECEETTLHDVNIEEEMRRKQQQQAQEAYDEDDEMPGGAQRVQCAQQ

SEQ ID NO: 14231 - protein, 417 aa, Euonymus alatus
MFGRAPKKSDNTRYYEVLGVPKNAGQDDLKKAYKKAAIKNHPDKGGDPEKFKELAHAYEVLSDPEKREIYDQYGEDALKEGMGGGGGGHDPFDIFSSFFGGSPFGGGSSRGRRQRRGEDVVHPLKVSLEDLYLGTSKKLSLSRNVICSKCNGKGSKSGASMTCAGCQGTGMKVSIRHLGPSMIQQMQHPCNECKGTGETISDKDRCPQCKGEKVVQEKKVLEVIVEKGMQNAQKITFPGEADEAPDTVTGDIVFVLQQKEHPRFKRKGDDLFVEHTLSLTEALCGFQFVLTHLDGRQLLIKSNPGEVVKPDSFKAINDEGMPVYQRPFMKGKLYIHFTVDFPDSVAPDQAKALEAILPSRPTSQLTDMELDECEETTLHDVNIEEEMRRKQHAAQQEAYDEDEEMPGGAQRVQCAQQ

SEQ ID NO: 14232 - protein, 418 aa, Flaveria ramosissima
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYLHFTVEFPDSLSADQCKALEAVLPTKPSMQMTDMELDECEETTLHDVNIEEEMRRKQQAAQEAYDEDEDMHGGAQRVQCAQQ

SEQ ID NO: 14233 - protein, 417 aa, Prunus persica
MFGRAPKKSDNTKYYEILGVSKTASQDDLKKAYRKAAIKNHPDKGGDPEKFKELAQAYEVLSDPEKREIYDQYGEDALKEGMGGGGGGHDPFDIFQSFFGGSPFGGGGSSRGRRQRRGEDVIHPLKVSLEDLYNGTSKKLSLSRNIICSKCRGKGSKSGASLKCPGCQGSGMKVSIRHLGPSMIQQMQHPCNECKGTGETINDKDRCTQCKGEKVVQEKKVLEVIVEKGMQNGQRITFPGEADEAPDTITGDIVFVLQQKEHPKFKRKGDDLFFEHTLSLVEALCGFHFVLTHLDGRQLLIKSQPGEVVKPDQFKAINDEGMPMYQRPFMKGKLYIHFTVEFPDSLNPEQCKGLEAVLPPRSSAQLTDMELDECEETTLHDVNIEEEMRRKQAQAQEAYDEDDDMHGGAQRVQCAQQ

SEQ ID NO: 14234 - protein, 417 aa, Vinca minor
MFGRAPKKSDNSKYYEILGVPKTASPEDLKKAYKKAAIKNHPDKGGDPEKFKELAHAYEVLSDPEKREIYDQYGEDALKEGMGSGGGMHDPFDIFQSFFGGSGFGGGSSRGRRQMRGEDVVHPLKVSLEDLFNGTTKKLSLSRNVICSKCSGTGSKSGASHKCSGCQGTGMKVTIRQLGPGMIQQMQHPCNECKGTGETISDKDRCPQCKGEKVLSEKKVLEVVVDKGMLNSQKITFPGEADEAPDTVTGDIVFVLQQKEHPKFKRKHADLFVEHTLSLTEALCGFQFILTHLDGRQLLIKSKPGEVIKPDQYKAIDDEGMPMYQRPFMRGKLYIHFTVEFPDSLSPDQVKALEGILPARAQSQLTDMELDECEETTLHDVNIEEEMRRKQAQAQQEAYDDDEDMHGGAQRVQCAQQ

SEQ ID NO: 14235 - protein, 417 aa, Gossypium hirsutum
MFGRAPKKSNNTRYYEILGVSNNASQDDLKKAYKKAAIKNHPDKGGDPEKFKELAQAYEVLSDPEKREIYDQYGEDALKEGMGGGAGAHDPFDIFSSFFGGSPFGGGSSRGRRQRRGEDVVHPLKVSLEDLYLGTSKKLSLSRNVICSKCNGKGSKSGASMTCPGCQGSGMKVSIRQLGPSMIQQMQHPCNECKGTGETINDKDRCPQCKGEKVVQEKKVLEVIVEKGMQNGQKITFPGEADEAPETVTGDIVFVLQQKDHPKFKRKGEDLFLEHTLSLTEALCGFQFVITHLDGRQLLIKSNPGEVVKPDSCKAINDEGMPLYQRPFMKGKLYIQFTVEFPDSLSPDQVKALEAILPPKPTSQLSDMELDECEETTLYDVNIEEEMRRKQQQAAQEAYEEDEDMHGGAQRVQCAQQ

SEQ ID NO: 14236 - protein, 418 aa, Vigna unguiculata
MFGRAPKKSDNTRYYEILGVSKNASQDDLKKAYKKAAIKNHPDKGGDPEKFKELAQAYEVLSDPEKREIYDQYGEDALKEGMGGGGGHDPFDIFSSFFGGGSPFGSGGSSRGRRQRRGEDVVHPLKVSLEDLYLGTSKKLSLSRNVICSKCSGKGSKSGASMKCAGCQGTGMKVSIRHLGPSMIQQMQHACNECKGTGETINDRDRCPQCKGEKVVQEKKVLEVIVEKGMQNGQKITFPGEADEAPDTITGDIVFVLQQKEHPKFRRKAEDLFVEHTLSLTEALCGFQFVLTHLDGRQLLIKSNPGEVVKPDSYKAINDEGMPMYQRPFMKGKLYLHFTVEFPDFLNPDQVKALEAVLPPKQPSQLTDMELDECEETTLHDVNMDEESRRRQQQAAQEAYEEDDDMPGGAQRVQCAQQ

SEQ ID NO: 14237 - protein, 417 aa, Vitis vinifera
MFGRAPKKSDNTRYYETLGVSKNASQDDLKKAYRKAAIKNHPDKGGDPEKFKELAQAYEVLSDPEKREIYDQYGEDALKEGMGGSGGGHDPFDIFQSFFGGSPFGGGGSSRGRRQRRGEDVVHPLKVSLEDLYIGTSKKLSLSRNVICSKCNGKGSKSGASIKCNGCQGSGMKVSIRQLGPSMIQQMQHPCNECKGTGETINDKDRCPQCKGEKVVQEKKVLEVIVEKGMQNGQKVTFPGEADEAPDTVTGDIVFVLQQKEHPKFKRKGDDLFVEHTLSLTEALCGFQFILTHLDGRQLLIKSNPGEVVKPDQFKAINDEGMPIYQRPFMRGKLYIQFNVEFPDTLSPEQCKALEAVLPARATTQLTDMELDECEETTLHDVNIEEEMRRKQAQAQEAYEEDEEMPGGAQRVQCAQQ

SEQ ID NO: 14238 - protein, 416 aa, Euonymus alatus
MFGRAPKKSDNTRYYEVLGVPKNAGQDDLKKAYKKAAIKNHPDKGGDPEKFKELAHAYEVLSDPEKREIYDQYGEDALKEGMGGGGGGHDPFDIFSSFFGGSPFGGGSSRGRRQRRGEDVVHPMKVSLEDLYLGTSKKLSLSRNVICSKCNGKGSKSGASMTCAGCQGTGMKVSIRHLGPSMIQQMQHPCNECKGTGETISDKDRCPQCKGEKVVQEKKVLEVIVEKGMQNGQKITFPGEADEAPDTVTGDIVFVLQQKEHPRFKRKGDDLFVEHTLSLTEALCGFQFVLTHLDGRQLLIKSNPGEVVKPDSFKAINDEGMPVYRRPFMKGKLYIHFTVDFPDSVAPDQVKALEAILPSRRTSQLTDMELDECEETTLHDVNIEEEMRRKQQAQQEAYDEDEEMPGGAQRVQCAQQ

SEQ ID NO: 14239 - protein, 419 aa, Lippia dulcis
MFGRAPKKSDNSRYYEILGVPKTASPDDLKKAYKKAAIKNHPDKGGDPEKFKELAHAYEVLSDPEKREIYDQYGEDALKEGMGGGGGMHDPFDIFSSFFGGSPFGGGGSSRGRRQRRGEDVVHPLKVSLEDLYLGTTKKLSLSRNVLCSKCNGKGSKSGASMKCSGCQGSGMKVTIRQLGPGMIQQMQHPCNECKGTGETITDKDRCSQCKGEKVVQEKKVLEVHVEKGMQNGQKITFPGEADEAPDTITGDIVFVLQQKEHPKFKRKGDDLFVEHSLTLTEALCGFQFILSHLDGRPLLIKSHPGEVVKPNSYKAINDEGMPMYQRPFMKGRLYIHFNVEFPDSLDVDQVAALEKILPPKPQSKLTDMEIDECEETTLHDVDIESEMRRKAAQQQEAYEEDDDDMHGGGAQRVQCAQQ

SEQ ID NO: 14240 - protein, 417 aa, Glycine max
MFGRAPKKSDSTRYYEILGVSKNASPDDLKKAYKKAAIKNHPDKGGDPEKFKELAQAYEVLSDPEKREIYDTYGEDALKEGMGGGGGGHDPFDIFSSFFGGSPFGSGGSSRGRRQRRGEDVVHPLKVSLEDLYLGTSKKLSLSRNVLCSKCNGKGSKSGASMTCAGCQGTGMKVSIRHLGPSMIQQMQHPCNECKGTGETINDRDRCQQCKGEKVVQEKKVLEVVVEKGMQNGQKITFPGEADEAPDTVTGDIVFVLQQKEHPKFKRKADDLFVEHTLSLTEALCGFQFVLAHLDGRQLLIKSNPGEVVKPDSYKAINDEGMPNYQRHFLKGKLYIHFSVEFPDTLSLDQVKALETTLPLKPTSQLTDMELDECEETTLHDVNMEEEIRRRQQAQQEAYEEDEDMHGGAQRVQCAQQ

SEQ ID NO: 14241 - protein, 418 aa, Flaveria ramosissima
MFGRAPKKSDNTKYYEILGVPQNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKELPKFKRKGDDLFVEHTLSLTEALCGFQFILTHLDNRQLLIKSQPGEVVKPDQFKAINDEGMPMYQRPFMRGKLYLHFTVEFPDSLSPDQCKALEAVLPPKPSMQMTDMELDECEETTLHDVNIEEEMRRKQQAAQEAYDEDEDMHGGAQRVQCAQQ

SEQ ID NO: 14242 - protein, 418 aa, Flaveria ramosissima
MFGRAPKKSDNTKYYEILGVPQNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPNFKRKGDDLFVEHTLSLTEALCGFQFILTHLDNRQLLIKSQPGEVVKPDQFKAINDEGMPMYQRPFMRGKLYLHFTVEFPDSLSPDQCKALEAVLPPKPSMQMTDMELDECEETTLHDVNIEEEMRRKQQAAQEAYDEDEDMHGGAQRVQCAQQ

SEQ ID NO: 14243 - protein, 419 aa, Flaveria ramosissima
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGSPFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYLHFTVEFPDSLSPEQCKALEAVLPPKPSMQMTDMELDECEETTLHDVNIEEEMRRKQQAAQEAYDEDEDMHGGAQRVQCAQQ

SEQ ID NO: 14244 - protein, 421 aa, Linum usitatissimum
MFGRAPKKSDNTKYYEILGVSQSASQDDLKKAYRKAAIKNHPDKGGDPEKFKELAQAYEVLSDPEKRDIYDQYGEDALKEGMGGGGGGHDPFDIFQSFFGGGGGNPFGAGGSSRGRRQRRGEDVVHPLKVSLEDLYNGTSKKLSLSRNALCSKCKGKGSKSGQSMKCSGCQGSGMKVSIRQLGPSMIQQMQHACNECKGTGEKINDKDRCPQCKGEKVMQEKKVLEVVVEKGMQNGQRITFPGEADEAPDTVTGDIVFVLQQKEHPKFKRKGDDLFVEHTLSLTEALCGFQFALTHLDGRQLLIKSQPGEVVKPDQFKAINDEGMPMYQRPFMRGKMYIHFGVDFPDSLSPDQSKALEGVLPARSSGQLSDMELDECEETTLHDVNIEDEMRRKQQAAQEAYDEDDEDMHGGAQRVQCAQQ

SEQ ID NO: 14245 - protein, 152 aa, Ambrosia trifida
MFGRAPKKSDNTKYYEILGVPKTASQDDLKKAYRKAAIKNHPDKGGDPEKFKELAQAYEVLSDPEKREIYDQYGEDALKEGMGGGGGGHDPFDIFQSFFGGSPFGGGGGGSSRGRRQQGVRTLFILSKFLLRIFITELPKALSFTQCKLLQV

SEQ ID NO: 14246 - protein, 335 aa, Citrullus lanatus
MGGGGGHDPFDIFQSFFGGSPFGGGSSRGRRQRRGEDVVHPLKVSLEDLYLGTSKKLSLSRNVICSKCNGKGSKSGASMNCSGCQGTGMKVTIRHLGPSMIQQMQHPCNECKGTGETISDKDRCSQCKGEKVVQEKKVLEVIVEKGMQNGQKITFPGEADEAPDTVTGDIVFVLQQKEHPKFKRKGEDLFVEHTLSLTEALCGFQFALTHLDGRQLLIKTNPGEVVKPDSFKAIDEEGMPVYQRPFMKGKLYIHFSVDFPDSLSPEQIKALEAVLPSKPSSQLTDMELDECEETTMHDVNIEEEMRRKQQQAQAEAYEEDEDMHGGAQRVQCAQQ

SEQ ID NO: 14247 - protein, 408 aa, Brassica napus
MFRRGPSSKSDNTKFYEILGVPKTASPEDLKKAYKKAAIKNHPDKGGDPEKFKELGEAYGVLSDPEKREIYDQYGEDGLKEGMSDRHDPFDIFSSFFGRNERRQRRGEDVVHPLRVSLEDLYLGTTKKLSLSRNALCSKCNGKGSKSGASLKCGGCQGKGMKVSIRQIGPGMIQQMQHVCQDCKGTGQTTNDRDRCPQCKGDKVIPEKKVLDVAVEKGMQNSQKITFRGQADEAPDTVTGDIVFVIQQKEHPKFKRKGDDLFVEHTLSLTEALCGFQFVLTHLDARQLLIKSSPGEVVKPDSYKAISDEGMPIHQRPFMKGKLYIHFTVEFPESLSRDQTKAFEAVLPKPAKSAMSDMEIDECEETTLHEVNIEAEMKRKAQAKREAYDDDDDEEGPGGGHGVQCAQQ

SEQ ID NO: 14248 - protein, 419 aa, Solanum lycopersicum
MFGRAPKKSDNTKYYEILGVPKTAAQEDLKKAYRKAAIKNHPDKGGDPEKFKELAQAYEVLSDPEKREIYDQYGEDALKEGMGGGGGGHDPFDIFSSFFGGSPFGGGGGSSRGRRQRRGEDVVHPLKVSLEDLYNGTSKKLSLSRNVLCPKCKGKGSKSGASMKCSGCQGSGMKVTIRQLGPSMIQQMQHPCNECKGTGEMINDKDRCGQCKGEKVVQEKKVLEVVVEKGMQNGQKITFPGEADEAPDTVTGDIVFVLQQKEHPKFKRKGDDLFVEHTLSLTEALCGFQFILTHLDTRQLIIKSQPGEVVKPDQFKAINDEGMPMYQRPFMRGKLYIHFTVEFPDTLSLEQCKNLEAVLPPKPKTQMTDMELDECEETTLHDVNIEEEMRRKQQQAQEAYDEDDEDMHGGAQRVQCAQQ

SEQ ID NO: 14249 - protein, 88 aa, Tripterygium wilfordii
MFGRAPKKSDNTRYYEVLGVPKNASQDDLKKAYRKAAIKNHPDKGGDPEKFKELAHAYEVLSDPEKREIYDQYGEDALKEGSGGWWRP

SEQ ID NO: 14250 - protein, 417 aa, Carica papaya
MFGRAPKKSDNTKYYEILGVSKNASQDDLKKAYRKAAIKNHPDKGGDPEKFKELAQAYEVLSDPEKREIYDQYGEDALKEGMGAGGGGHDPFDIFQSFFGGNPFGGGGSSRGRRQRRGEDVVHPLKVSLEDLYNGTSKKLSLSRNIICSKCKGKGSKSGASMKCPSCQGSGMKISIRQLGPGMIQQMQHPCNECKGTGETINDKDRCPQCKGDKVVQEKKVLEVIVEKGMQNGQKITFPGEADEAPDTITGDIVFVLQQKEHPKFKRKGDDLFVEHTLSLTEALCGFQYVLTHLDGRQLLIKSQPGEVVKPDQFKAINDEGMPIYQRSFMKGKLYIHFSVDFPDSLSPEQCKSLEAVLPPRTSVELTDMELDECEETTLHDVNIEEEMRRKQAQAQEAYEEDDDMHGGAQRVQCAQQ

SEQ ID NO: 14251 - protein, 417 aa, Medicago truncatula
MFGRAPKKSDNTKYYEILGVSKNASPDDLKKAYKKAAIKNHPDKGGDPEKFKELAQAYEVLSDPEKREVYDQYGEDALKEGMGGGGGGHDPFDIFSSFFGGGGFPGGGSSRGRRQRRGEDVVHPLKVSLEDLYLGTSKKLSLSRNVLCSKCNGKGSKSGASMTCAGCQGSGMKISMRHLGANMIQQMQHPCNECKGTGETISDKDRCPQCKGEKVVQQKKVLEVHVEKGMQNGQKITFPGEADEAPDTVTGDIVFVLQQKEHPKFKRKGEDLFVEHTLSLTEALCGFQFALTHLDSRQLLIKSNPGEVVKPDSYKAINDEGMPMYQRPFMKGKLYIHFTVEFPESLTLDQVKALETILPARPVSQLTDMELDECEETTLHDVNIEEETRRRQQAQQEAYDEDDEMPGGAQRVQCAQQ

SEQ ID NO: 14252 - protein, 420 aa, Lactuca sativa
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGGNPFGGAGGSSRGRRQRRGEDVIHPLKVSLEDLYNGTSKKLSLSRNVLCSKCKGKGSKSGASMKCAGCQGSGMKVSIRHLGPSMIQQMQHPCNECKGTGETINDKDRCTQCKGEKVVQEKKVLEVHVEKGMQNSQKITFPGEADEAPDTVTGDIVFVLQQKEHPKFKRKGDDLFVEHTLSLTEALCGFQFILTHLDSRQLLIKSEPGEVVKPDQFKAINDEGMPMYQRPFMKGKLYIHFTVEFPESLSPEQCKALEGVLPPKPSMQMTDMELDECEETTLHDVNIEEEMRRKQQQQAQEAYDEDDEMPGGAQRVQCAQQ

SEQ ID NO: 14253 - protein, 417 aa, Aristolochia fimbriata
MFGRAPKKSDSTRYYEILGVSKNASQDDLKKAYRKAAIKNHPDKGGDPEKFKELAQAYEVLSDPEKREIYDQYGEDALKEGMGGGGGGHDPFDIFQSFFGGNPFGGGGSSRGRRQRRGEDVMHPLKVSLEELYNGTSKKLSLSRNVICSKCKGKGSKSGASMKCSGCQGSGMKVSIRHLGPSMIQQMQHPCNECKGTGETINDKDRCPQCKGEKVVQEKKVLEVHVEKGMQNGQKITFPGEADEAPDTVTGDIVFILQQKEHPKFKRKGDDLFVEHTLSLTEALCGFQFVLTHLDGRQLLIKSQPGEVVKPDQFKAINDEGMPMYQRPFMKGKLYIHFTVEFPDTLSPDQCKALESVLPPRAGTQLTDMELDECEETTLHDVNIEEEMRRKQAHAQEAYDEDDDPHGGPQRVQCAQQ

SEQ ID NO: 14254 - protein, 416 aa, Vitis vinifera
MFGRAPKKSDNTKYYDVLGVSKNASQEDLKKAYRKAAIKNHPDKGGDPEKFKELAQAYEVLSDPEKREIYDQYGEDALKEGMGGGGGGHDPFDIFQSFFGGNPFGGGGSSRGRRQRRGEDVIHPLKVSLEDLYNGTSKKLSLSRNVICSKCKGKGSKSGASMKCSGCQGSGMKVSIRHLGPSMIQQMQHPCNECKGTGETINDKDRCPQCKGEKVVQEKKVLEVIVEKGMQNGQRITFPGEADEAPDTVTGDIVFVLQQKEHPKFKRKGDDLFVEHTLSLTEALCGFQFILTHLDGRQLLIKSHPGEVVKPDQFKAINDEGMPIYQKPFMKGKLYIHFAVDFPDSLNTDQCKALEAVLPPRTSTQLTDMEIDECEETTLHDVNIEEEMRRKQAAQEAYEEDEDIHGGAQRVQCAQQ

SEQ ID NO: 14255 - protein, 418 aa, Phaseolus coccineus
MFGRAPKKSDNTRYYEILGVSKNASQDDLKKAYKKAAIKNHPDKGGDPEKFKELAQAYEVLSDPEKREVYDQYGEDALKEGMGGGGGHDPFDIFSSFFGGGSPFGSGGSSRGRRQRRGEDVVHPLKVSLEDLYLGTSKKLSLSRNVICSKCTGKGSKSGASMKCAGCQGTGMKVSIRHLGPSMIQQMQHACNECKGTGETINDRDRCPLCKGEKVVQEKKVLEVIVEKGMQNGQKITFPGEADEAPDTITGDIVFVLQQKEHPKFRRKAEDLFVEHTLSLTEALCGFQFVLTHLDSRQLLIKSNPGEVVKPDSYKAINDEGMPMYQRPFMKGKLYLHFTVEFPDFLNPEQVKALEAVLPPKQPSQLTDMELDECEETTLHDVNMEDETRRRQQQAAQEAYEEDDDMPGGAQRVQCAQQ

SEQ ID NO: 14256 - protein, 418 aa, Antirrhinum majus
MFGRAPKKSDNSRYYEVLGVPKTAAPDDLKKAYKKAAIKNHPDKGGDPEKFKELAHAYEVLSDPEKREIYDQYGEDALKEGMGGGGAGMHDPFDIFSSFFGGSPFGGGGSRGRRQRRGEDVVHPLKVSLEDLYLGSTKKLSLSRNVLCSKCSGKGSKSGASTKCSGCRGSGMKVTIRQLGPGMIQQMQHPCNECKGTGETISDRDRCPQCKGEKVVQEKKVLEVHVEKGMQNGQKITFPGEADEAPDTVTGDIVFVLQQKEHPKFKRKNGDDLFVEHSLSLTEALCGFQFILPHLDGRQLLIKSEPGEVVKPDSYKAVNDEGMPMYQRPFMKGKLYIHFNVDFPDSLSLDQVQALGKILPAKAQPQLTDMELDECEETTLHDVNIEDELRRKAQHQEAYEEDDEDMHGGAQRVQCAQQ

SEQ ID NO: 14257 - protein, 418 aa, Quercus alba
MFGRAPKKSDNTKYYEILGVSKNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVIHPLKVSLEDLYNGTSKKLSLSRNVICSKCKGKGSKSGASMKCSGCQGSGIKISIRHLGPSMIQQMQHACNECKGTGETINDKDRCPQCKGEKVVQEKKVLEVIVEKGMQNGQRITFPGEADEAPDTTTGDIVFVLQQKEHPKFKRKGEDLFVEHTLSLTEALCGFQFILTHLDGRPLLIKSEPGEVVKPDQYKAINDEGMPVYQRAFMKGKLYIHFTVEFPDALNPEQCKSLEAVLPPRTSVQLTDMELDECEETTLHDVNIEDEMRRKQAQAQEAYEEDDDMPGGAQRVQCAQQ

SEQ ID NO: 14258 - protein, 417 aa, Fagopyrum esculentum
MFGRAPKKSDNTKYYEILGVSKDASPDDLKKAYKKAAIKNHPDKGGDPEKFKELAQAYEVLSDPEKREIYDQYGEDALKEGMGGGGGGHNPFDIFESFFGGNPFGGGGGSSRGRRQRRGEDVIHPLKVSLEDLYSGTSKKLSLSRNVICSKCNGKGSKSGASMTCGGCQGSGMKVSIRQLGPSMIQQMQHPCNECKGTGETINDKDRCPDCKGEKVVQEKKVLEVIVEKGMQHGQKITFPGEADEAPDTITGDIVFVLQQKDHSKFKRKGDDLFYEHTLSLTEALCGFKFVLTHLDGRQLLIKSNPGEVIKPDQFKAIDDEGMPMYQRPFMKGKLYVHFTVDFPDSLSPEQVKALETVLPPRSGSELTDMELDECEETTLHDVNIEEEMRRKQAQAQEAYDEDDEPHGAQRVQCAQQ

SEQ ID NO: 14259 - protein, 419 aa, Flaveria ramosissima
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGSPFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYLHFTVEFPDTFSPEQCKALEAVLPPKPSMQMTDMELDECEETTLHDVNIEEEMRRKQQAAQEAYDEDEDMHGGAQRVQCAQQ

SEQ ID NO: 14260 - protein, 419 aa, Flaveria ramosissima
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGSPFGGGGGGSSRGRRQRRGEDVVHPLKVSLEDLYNGTSKKLSLSRNIICSKCKGKGSKSGASMKCAGCQGSGVKVSIRHLGPSMIQQMQHACNECKGTGETINDKDRCTQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYIHFTVDFPDSLSPEQCKALEAVLPPKPSMEMTDMELDECEETTLHDVNIEEEMRRKQQQAQEAYDEDEDMHGGAQRVQCAQQ

SEQ ID NO: 14261 - protein, 417 aa, Flaveria ramosissima
GRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGSPFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCAQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYLHFTVEFPDSLSPEQCKALEAVLPPKPSMQMTDMELDECEETTLHDVNIEEEMRRKQQAAQEAYDEDEDMHGGAQRVQCAQQ

SEQ ID NO: 14262 - protein, 420 aa, Humulus lupulus
MFGRGPKKSDNTKYYEVLGVSKNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVIHPLKVSLEDLYNGTSKKLSLSRNVLCSKCKGKGSKSGASMKCPVCQGSGMKISIRQLGPSMIQQMQHPCNECKGTGETINDKDRCTQCKGDKVVQEKKVLEVNVEKGMQNGQRITFPGEADEAPDTVTGDIVFILQQKEHPKYKRKGDDIFYEHTLSLTEALCGFQFILTHLDGRQLLIKSQPGEVVKPEQFKAINDEGMPMYQRPFMKGKLYIHFTVEFPDSLSPEQCKALETVLPPRAGVQLTDMEIDECEETTMHDVNIEEEMRRKQAQAQEAYDEDDDMHGGGGAQRVQCAQQ

SEQ ID NO: 14263 - protein, 416 aa, Helianthus annuus
MFGRAPKKSDNTKYYEILGVPKNASQDDLKKAYRKAAIKNHPDKGGDPEKFKELAQAYEVLSDPEKREIYDEYGEDALKEGMGGGGGGHDPFDIFQSFFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFVEHTLSLTEALCGFQFVLTHLDNRQLLIKSQPGEVVKPDQFKAINDEGMPMYQRPFMRGKLYIHFTVDFPDSLSPEQCKALEGVLPPKPSQQLTDMELDECEETTLHDVNIEEEMRRKQQQQAQEAYDEDEEDMHGGAQRVQCAQQ

SEQ ID NO: 14264 - protein, 418 aa, Vigna unguiculata
MFGRAPKKSDSTRYYEILGVAKNASQEDLKKAYKKAAIKNHPDKGGDPEKFKELAQAYEVLSDPEKREIYDTYGEDALKEGMGGGGGGHDPFDIFSSFFGGNPFAGGGSGRGRRQRRGEDVVHPLKVSLEDLYLGTSKKLSLSRNVLCSKCNGKGSKSGASMTCAGCQGTGMKLSIRHLGPSMIQQMQHPCNECKGTGETISDRDRCTQCKGEKVVQEKKVLEVVVEKGMQNGQKITFPGEADEAPDTITGDIVFVLQQKEHPKFKRKAEDLFVEHTLSLTEALCGFQFVLAHLDGRQLLIKSNPGEVVKPDSYKAINDEGMPMYQRPFMKGRLYIHFTVEFPDSLSLDQVKAIEAVLPAKTSSQKLTDMELDECEETTLHDVNMEEESRRRQQSSQEAYEEDEDIHGGAQRVQCAQQ

SEQ ID NO: 14265 - protein, 417 aa, Theobroma cacao
MFGRAPKKSDNTKYYEILGVSKNASQDDLKKAYRKAAIKNHPDKGGDPEKFKELAQAYEVLSDPEKREIYDQYGEDALKEGMGGGGGGHDPFDIFQSFFGGNPFGGGGSSRGRRQRRGEDVIHPLKVSLEDLYNGTSKKLSLSRNIICFKCKGKGSKSGASMKCSGCQGSGMKVSIRHLGPSMIQQMQHPCNECKGTGETINDKDRCPQCKGEKVVQEKKVLEVIVEKGMQNGQRITFPGEADEAPDTVTGDIVFVLQQKEHPKFKRKGDDLFVEHTLTLTEALCGFQFILTHLDGRQLLIKSQPGEVVKPDQFKAINDEGMPMYQRPFMRGKLYIHFTVDFPDSLIPDQCKALEAVLPPRTSVQLTDMELDECEETTLHDVNIEEEMRRKQAQAQEAYEEDEDMHGGAQRVQCAQQ

SEQ ID NO: 14266 - protein, 417 aa, Zingiber officinale
MFGRGPNKSDNTRYYEVLGVPKTASQEDLKKAYRKAAIKNHPDKGGDPEKFKELAQAYEVLSDPEKREIYDQYGEDALKEGMGGGGGHNPFDIFESFFGGSPFGGGGSSRGRRQRRGDDVIHPLKVSLEDLYNGTSKKLSLSRNVICQKCSGKGSKSGASAKCSGCQGSGMKVTIRQLGPGMIQQMQHPCNECKGTGETINEKDRCPKCKGEKVVQEKKVLEVVVEKGMQNGQKITFPGEADEAPDTVTGDIVFVLQQKEHPKFKRKGDDLFYEHTLSLTEALCGFQFILTHLDNRQLLIKSNPGEVVKPDQFKAINDEGMPMYQRPFMKGKLYIHFSVDFPDSLTPDQCKALEAVLPPKPGAQMTDMELDECEETTLHDVNIEEEMRRKQAQAQEAYEEDDDGPGGGAQRVQCAQQ

SEQ ID NO: 14267 - protein, 417 aa, Euphorbia peplus
MFGRAPKKSDNTKYYEILGVSKSASQDDLKKAYRKAAIKNHPDKGGDPEKFKELAQAYEVLSDPEKREIYDQYGEDALKEGMGGGGGGHDPFDIFQSFFGGSPFGGGGSSRGRRQRRGEDVTHPLKVSLEDLYNGTSKKLSLSRNVICSKCKGKGSKSGASMKCSGCQGSGMKVSIRQLGPSMIQQMQHACNECKGTGETINDKDRCPQCKGEKVVQEKKVLEVIVEKGMQNGQKITFPGEADEAPDTITGDIVFILQQREHPKFKRRGDDLIVEHTLSLTEALCGFQFILTHLDGRQLLIKSQPGEVVKPDQFKAINDEGMPIYQRPFMRGKLYIHFNVEFPDSLPPEQSKALEAVLPSRTAVQLSDMELDECEETTLHDVNFEEEMRRKQQQSAEAYDEDEDMHGGAQRVQCAQQ

SEQ ID NO: 14268 - protein, 418 aa, Orobanche aegyptiaca
MFGRAPKKSDNSKYYEILGVPKTATPDDLKKAYKKAAIKNHPDKGGDPEKFKELAHAYEILSDPEKREIYDQYGEDALKQDMGGGGGMHDPFDIFSSFFGGSPFGGGGSSRGRRQRRGEDVVHPLKVSLEDVYLGTTKKLSLSRNVLCSKCNGKGSKSGASLKCPGCQGAGMKVSIRQLGPGMIQQMQHPCNECKGTGETISDKDRCTHCKGEKVAQEKKVLEVHVEKGMQNGQKITFPGEADEAPDTVTGDIVFVLQQKEHPKFKRKGDDLFVEHTLSLAEALCGFQFILSHLDSRQLLIKSQPGEVVKPNSYKAINDEGMPMYQRPFMKGRLYIHFNVEFPDSLGVDQVEALSKIFPAKAQSQLTDMEIDECEETTLHDVNIEDEMRRKAQQHQEAYDEDDEDMHGGAQRVQCAQQ

SEQ ID NO: 14269 - protein, 421 aa, Lactuca sativa
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGGNPFGGGGGGSSRGRRQRRGEDVIHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNSQKITFPGEADEAPDTVTGDIVFVLQQKEHPKFKRKGDDLFVEHTLSLTEALCGFQFILTHLDSRQLLIKSEPGEVVKPDQFKAINDEGMPMYQRPFMKGKLYIHFTVEFPESLSPEQCKALEGVLPPKPSMQMTDMELDECEETTLHDVNIEEEMRRKQQQQAQEAYDEDEDMHGGAQRVQCAQQ

SEQ ID NO: 14270 - protein, 415 aa, Ambrosia trifida
MFGRAPKKSDNTKYYEILGVPKNASQDDLKKAYRKAAIKNHPDKGGDPEKFKELAQAYEVLSDPEKREIYDEYGEDALKEGMGGGGGGHDPFDIFSSFFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFFEHTLSLTEALCGFQFVLTHLDNRQLLIKSQPGEVVKPDQFKAINDEGMPMYQRPFMRGKLYIHFTVDFPDSLSPEQCKALEAVLPPKPSQQMTDMELDECEETTLHDVNIEEEMRRKQQQAAQEAYDEDEDMHGGAQRVQCAQQ

SEQ ID NO: 14271 - protein, 419 aa, Ambrosia trifida
MFGRAPKKSDNTKYYEILGVPKNASQDDLKKAYRKAAIKNHPDKGGDPEKFKELAQAYEVLSDPEKREIYDEYGEDALKEGMGGGGGGHDPFDIFSSFFGGSPFGGGGGGSSRGRRQRRGEDVVHPLKVSLEDLYNGTSRKLSLSRNVICSKCKGKGSKSGASMKCAGCQGSGMKVSIRHLGPSMIQQMQHPCNECKGTGETINDKDRCSQCKGEKVVQEKKVLEVHVEKGMQNGQKITFPGEADEAPDTVTGDIVFVLQQKEHPKFKRKGDDLFVEQTLSLTEALCGFQFVLTHLDNRQLLIKSQPGEVVKPDQFKAINDEGMPMYQRPFMRGKLYIHFTVDFPDSLSPEQCKALEAVLPPKSSQQMTDMELDECEETTLHDVNIEEEMRRKQQQAQEAYDEDEDMPGGAQRVQCAQQ

SEQ ID NO: 14272 - protein, 421 aa, Chelidonium majus
MFGRGAPKKSDNTKYYEILGVSKTASPEDLKKAYRKAAIKNHPDKGGDPEKFKELAQAYEVLSDPEKREIYDQYGEDALKEGMGGGGGGHDPFDIFQSFFGGGSPFGGGGGSSRGRRQRRGEDVMHSLKVSLEDLYSGTSKKLSLSRNVLCSKCNGKGSKSGASMKCSGCQGSGMKVSIRHLGPSMIQQMQHPCNECKGTGETISDKDRCTVCKGEKVVQEKKVLEVHVEKGMQNGQKITFPGEADEAPDTVTGDIVFVLSQKDHPKFKRKGDDLFVEHTLSLTEALCGFQFVLTHLDGRQLLIKTNPGEVVKPDQFKAVNDEGMPIYQRPFMRGKLYIHFTVEFPESLTIEQCKALEAVLPARTSSQLTDMELDECEETTLHDVNIEEEMRRKQAQAQQEAYDEDEDMPGGAQRVQCAQQ

SEQ ID NO: 14273 - protein, 419 aa, Flaveria ramosissima
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGSPFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYLHFTVDFPDSLSPEQCKALEAVLPPKPLMQMTDMELDECEETTLHDVNIEEEMRRKQQAAQEAYDEDEDMHGGAQRVQCAQQ

SEQ ID NO: 14274 - protein, 419 aa, Papaver somniferum
MFGRAPKKSDNTKYYEVLGVPKTASPEDLKKAYRKAAIKNHPDKGGDPEKFKELAQAYEVLSDPEKREIYDQYGEDALKEGMGGGGGGHDPFDIFSSFFGGGSPFGGGGSSRGRRQRRGEDVMHSLKVSLEDLYSGTSKKLSLSRNVICSKCTGKGSKSGASMKCSGCQGSGMKVSIRHLGPSMIQQMQHPCNECKGTGETISDKDRCPQCKGEKVAQEKKVLEVHVEKGMQNGQKITFPGEADEAPETVTGDIVFVLAQKDHPKFKRKGDDLFVEHTLSLTEALCGFQFALTHLDGRQLLIKTNPGEVVKPDSFKAVNDEGMPMYQRPFMRGKLYIHFTVDFPDSLTAEQCKALEGVLPPRTSSQLTDMEVDECEETTLHDVNIEEEMRRKQAQAQEAYDEDDDMHAGGAQRVQCAQQ

SEQ ID NO: 14275 - protein, 420 aa, Helianthus annuus
MFGRAPKKSDNTKYYEILGVPKTASQDDLKKAYRKAAIKNHPDKGGDPEKFKELAQAYEVLSDPEKREIYDQYGEDALKEGMGGGGGGHDPFDIFQSFFGGSPFGGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDSFKAINDEGMPMYQRPFMRGKLYIHFTVEFPESLSPEKCKALEAVLPPKPSMQMTDMQLDECEETTLHDVNIEEEMRRKQQQAAQEAYDEDEDMHGGAQRVQCAQQ

SEQ ID NO: 14276 - protein, 420 aa, Taraxacum officinale
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGGNPFGGASGSSRGRRQRRGEDVIHPLKVSLEDLYNGTSKKLSLSRNVLCSKCKGKGSKSGASMKCAGCQGSGMKVSIRHLGPSMIQQMQHPCNECKGTGETINDKDRCPQCKGEKVVQEKKVLEVHVEKGMQNSQKITFPGEADEAPDTVTGDIVFVLQQKEHPKFKRKGDDLFVEHTLSLTEALCGFQFTLTHLDSRQLLIKSQPGEVVKPDAFKAINDEGMPMYQRPFMRGKLYIHFTVEFPESLSPEQCKALEGVLPPKPAMQMTDMELDECEETTLHDVNIEEEMRRKQQQAAQEAYDEDDDMHGGAQRVQCAQQ

SEQ ID NO: 14277 - protein, 339 aa, Triphysaria pusilla
MGGGGGGGMNDPFDIFSSFFGGSPFGGGGSSRGRGQRRGEDVVHSLKVSLEDLYLGTTKKLSLSRNVLCSKCNGKGSKSGASSTCSGCQGSGMKVSIRQLGPGMIQQVQHPCNVCKGTGETISDKDRCIQCKSDKVAQQKKVLEVHVEKGMQNSQKITFPGEADEAPDTVTGDIVFVLQQKEHPKFKRKGDDLFIEHSLSLTESLCGFQFLLTHLDGRQLLIKSPAGEVVKPNSYKAINDEGMPMYGRPFMKGKLYIHFNVEFPDSLAVEQVEALEKILPPKNQTQLTDMEIDECEETTLHDVNIEDEMRRKAQAHQEAYDEDDEDMHGGAQRVQCAQQ

SEQ ID NO: 14278 - protein, 418 aa, Phaseolus coccineus
  misc_feature (389)..(389): Xaa can be any naturally occurring amino acid
MFGRAPKKSDSTRYYEILGVAKNASPEDLKKAYKKAAIKNHPDKGGDPEKFKELAQAYEVLSDAEKREIYDTYGEDALKEGMSGGGGGHDPFDIFSSFFGGNPFGGGGSSRGRRQRRGEDVVHPLKVSLEDLYLGTSKKLSLSRNVLCSKCNGKGSKSGASMTCAGCQGSGMKLSIRHLGPSMIQQMQHPCNECKGTGETISDRDRCTQCKGEKFVQDKKVLEVVVEKGMQNAQKITFPGEADEAPDTITGDIVFVLQQKEHPKFKRKIEDLFVEHTLSLTEALCGFQFVLTHLDGRQLLIKSNPGEVVKPDSYKAINDEGMPMYQRPFMKGKLYIHFTVEFPDSLSPDQVTAIEAVLPAKTSPQKLTEMELDECEETTLHGVNMEEEXRRRQQIPQEAYEEDDDMHGGAQRVQCAQQ

SEQ ID NO: 14279 - protein, 418 aa, Ricinus communis
MFGRAPKKSDNTKYYEILGVSKNASQDDLKKAYRKAAIKNHPDKGGDPEKFKELAQAYEVLSDPEKREIYDQYGEDALKEGMGGGGGGGHDPFDIFQSFFGGSPFGGGGSSRGRRQRRGEDVIHPLKVSLEDLYNGTSKKLSLSRNVICSKCKGKGSKSGASMKCSGCQGSGMKVSIRHLGPSMIQQMQHPCNECKGTGETINDKDRCPQCKGEKVVQEKKVLEVIVEKGMQNGQKITFPGEADEAPDTITGDIVFVLQQKEHPKFKRKGDDLVVEHTLSLTEALCGFQFILTHLDGRQLLIKSQPGEVVKPDQFKAINDEGMPMYQRPFMRGKLYIHFSVDFPDSLPPDQCKALETVLPSRTSVQLSDMELDECEETTLHDVNFEEEMRRKQQQAQEAYDEDEDMHGGAQRVQCAQQ

SEQ ID NO: 14280 - protein, 416 aa, Castanea mollissima
MFGRAPKKSDNTKYYEVLGVSKNASQDDLKKAYRKAAIKNHPDKGGDPEKFKELAQAYEVLSDPEKREIYDQYGEDALKEGMGGGGGGHDPFDIFQSFFGGSPFGGGGSSRGRRQRRGEDVIHPLKVSLEDLYNGTSKKLSLSRNVICSKCKGKGSKSGASMKCSGCQGSGIKISIRHLGPSMIQQMQHACNECKGTGETINDKDRCPQCKGEKVVQEKKVLEVIVEKGMQNGQRITFPGEADEAPDTTTGDIVFVLQQKEHPKFKRKGEDLFVEHTLSLTEALCGFQFILTHLDGRQLLIKSEPGEVVKPDQYKAINDEGMPMYQRAFMKGKLYIHFTIEFPDTLNPEQSKSLEAVLPPRTSVQLTDMELDECEETTLHDVNIEDEMRRKQAQAQEAYDEDDDMPGGGQRVQCAQ

SEQ ID NO: 14281 - protein, 418 aa, Cirsium arvense
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGNPFGGGGGSSRGRRQRRGEDVIHPLKVSLEDLYNGTSKKLSLSRNVICSKCKGKGSKSGASMKCAGCQGSGMKVSIRHLGPSMIQQMQHPCNECKGTGETINDKDRCPQCKGEKVVQEKKVLEVHVEKGMQNGQKITFPGEADEAPDTVTGDIVFVLQQKEHPKFKRKGDDIFVEHTLSLTEALCGFQFILTHLDSRQLLIKSQPGEVVKPDQFKAINDEGMPMYQRPFMRGKLYIHFTVEFPDSLSPEQCKALEGVLPARPSMQMTDMELDECEETTLHDVNIEEEMRRKQQAAQEAYDEDEDMHGGAQRVQCAQQ

SEQ ID NO: 14282 - protein, 416 aa, Unknown
  Sequence found in Organisms: Citrus sinensis, Citrus sinensis
MFGRAPKKSDNTKYYEILGVSKNASQDDLKKAYRKAAIKNHPDKGGDPEKFKELAQAYEVLSDPEKREIYDQYGEDALKEGMGGGGGAHDPFDIFQSFFGGSPFGGGSSRGRRQRRGEDVIHPLKVSLEDLYNGTSKKLSLSRNVICTKCKGKGSKSGASMKCSGCQGSGMKVSIRHLGPSMIQQMQHPCNECKGTGETINDKDRCPQCKGEKVIQEKKVLEVIVEKGMQNGQKITFPGEADEAPDTVTGDIVFVLQQKEHPKFKRKGDDLFVEHTLSLTEALCGFQFVITHLDGRQLLIKSQPGEVVKPDQFKAINDEGMPMYQRPFMRGKLYIHFTVDFPESLSPDQCKMLETVLPPRTSVQLTDMELDECEETTLHDVNIEEEMRRKQQAAQEAYDEDDDMQGGAQRVQCAQQ

SEQ ID NO: 14283 - protein, 418 aa, Phalaenopsis aphrodite
MFGRAPKKSDNTRYYEILGVSKSASQDDLKKAYRKAAIKNHPDKGGDPEKFKELAQAYEVLSDPEKRDIYDQYGEDALKEGMGGGGAGHDPFDIFQSFFGGNPFGGGGSSRGRRQRRGEDVVHPLKVTLEDLYNGTSKKLSLSRNVLCSKCKGKGSKSGASMKCSGCQGTGMKVSIRQLGPSMIQQMQHPCNECKGTGETINDKDRCPQCKGEKVTQEKKVLDVLVEKGMQNGQKITFPGEADEAPDCITGDIVFVLQQKDHSKFKRKGDDLFVEHTLSLTEALCGFQFILTHLDGRQLLIKSNPGEVVKPDQFKAINDEGMPMYQRPFMRGKIYIHFTVEFPDSLSPDQCKALEAILPSRARTQLTDMELDECEETTLHDVNIEEEMRRKQQSQAQEAYDEDEDMPGGAQRVQCAQQ

SEQ ID NO: 14284 - protein, 419 aa, Saccharum officinarum
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRNVLCSKCKGKGSKSGASMRCPGCQGSGMKVTIRQLGPSMIQQMQQPCNECKGTGESINEKDRCPGCKGEKVVQEKKVLEVHVEKGMQHNQKITFPGEADEAPDTVTGDIVFVLQQKDHSKFKRKGEDLFYEHTLSLTEALCGFQFVLTHLDNRQLLIKSNPGEVVKPDQFKAINDEGMPIYQRPFMKGKLYIHFTVEFPDSLAPEQCKALEAVLPPRSSSKLTDMEIDECEETTMHDVNNIEEEMRRKQAHAAQEAYEEDDEMPGGAQRVQCAQQ

SEQ ID NO: 14285 - protein, 148 aa, Ambrosia trifida
MFGRAPKKSDNTKYYEILGVPKTASQDDLKKAYRKAAIKNHPDKGGDPEKFKELAQAYEVLSDPEKREIYDQYGEDALKEGMGGGGGGGHDPFDIFQSFFGGGSPLVVVVAAAGDEGNEGERMLFIPSKFLSRIFTMELPRNYLFHAT

SEQ ID NO: 14286 - protein, 416 aa, Arnica chamissonis
MFGRAPKKSDNTKYYEILGVPKNASQDDLKKAYRKAAIKNHPDKGGDPEKFKELAQAYEVLSDPEKREIYDEYGEDALKEGMGGGGGGGGHDPFDIFQSFFGGGGGGSSRGRRQRRGEDVVHPLKVSLEDLYNGTSKKLSLSRNVICSKCKGKGSKSGASMKCNGCQGSGMKVSIRHLGPSMIQQMQHPCNECKGTGETINDKDRCAQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDQFKAINDEGMPMYQRPFMRGKLYIHFTVEFPDSISPEQCKALEAVLPPKPSMEMTDMELDECEETTLHDVNIEEEMRRKQQAAHEAYDEDEDMPGGAQRVQCAQQ

SEQ ID NO: 14287 - protein, 418 aa, Cirsium arvense
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGNPFGGGGGSSRGRRQRRGEDVIHPLKVSLEDLYNGTSKKLSLSRNVICSKCKGKGSKSGASMKCAGCQGSGMKVSIRHLGPSMIQQMQHPCNECKGTGETINDKDRCPQCKGEKVVQEKKVLEVHVEKGMQNGQKITFPGEADEAPDTVTGDIVFVLQQKEHPKFKRKGDDIFVEHTLSLTEALCGFQFILTHLDSRQLLIKSQPGEVVKPDQFKAINDEGMPMYQRPFMRGKLYIHFTVEFPDSLTPEQCKALEGVLPARPSMQMTDMELDECEETTLHDVNIEEEMRRKQQAAQEAYDEDEDMHGGAQRVQCAQQ

SEQ ID NO: 14288 - protein, 418 aa, Linum usitatissimum
MFGRAPKKSDNTKYYEILGVPKTASPEDLKKAYRKAAIKNHPDKGGDPEKFKELAQAYEVLSDPEKREIYDQYGEDALKEGMGGGGGGHNPFDIFESFFGGGAFGGGSSRGRRQRRGEDVVHPLKVSLEDLYLGTTKKLSLSRNVICSKCSGKGSKSGASMKCAGCQGSGMKVSIRQLGPGMIQQMQHPCNECKGTGESISDKDRCSQCKGEKVVPEKKVLEVHVEKGMQNGQKITFPGEADEAPETITGDIVFVLQQKENPRFKRKGDDLFVEHSLALTEALCGFRFALTHLDGRQLLIKSLPGEVVKPDSFKAINDEGMPMYQKPFLKGKLYIHFTVDFPDSLSPDQVKALEAILPAKSSSRLTDMEIDECEETPMHDVNIEEEMRRKQQQSRHEAYDEEDEDMPGGAQRVQCAQQ

SEQ ID NO: 14289 - protein, 422 aa, Mimulus guttatus
MFGRAPPSKSDNTKYYEVLGVPKTASPDDLKKAYRKAAIKNHPDKGGDPEKFKELAHAYEVLSDPEKREIYDQYGEDALKEGMGGGGGGGMHDPFDIFSSFFGGSPFGGGGSSRGRRQRRGEDVVHALKVSLEDLYLGTSKKLSLSRNVLCKKCNGKGSKSGASLKCTGCQGSGMKVSIRQLGRGMIQQMQQPCGDCRGTGETINDKDRCPQCKGDKVVQEKKVLDVHVDKGMQNGQKITFPGEADEAPDTVTGDIVFVVQQKEHPKYKRKGDDLFIEHTLPLGEALCGFQFALSHLDGRQLLIKSQPGEVVKPDSYKAINDEGMPIYQRPFMKGKLYIHFNVEFPDSLSTEQVEALEKILPPKPQSKLTDMEVDECEETTLHDVNIEDEMRRKQAHRQQEAYDDDDEDMHGGAQRVQCAQQ

SEQ ID NO: 14290 - protein, 418 aa, Gossypium hirsutum
MFGRAPKKSDNTKYYEILGVPKTASQDDLKKAYRKAAIKNHPDKGGDPEKFKELAQAYEVLSDPEKREIYDQYGEDALKEGMGGGGGAHDPFDIFQSFFGGNPFGGGGSSRGRRQRRGEDVIHPLKVSLEDLYNGTSKKLSLSRNIICSKCKGKGSKSGASMKCSGCQGSGMKVSIRHLGPSMIQQMQHPCNDCKGTGETINDKDRCPQCKGEKVVQEKKVLEVNVEKGMQNGQKITFPGEADEAPDTVTGDIVFVLQQKDHPKFKRKGDDLFVEHTLTLTEALCGFQFILTHLDGRQLLIKTHPGEVVKPDQCKAINDEGMPMYQRPFMRGKLYIHFTVDFPDSLAPEQCKALEAVLPPRTSVQLTDMELDECEETTLYDVNIEEEMRRKQAQAAQEAYEEDDDMHGGAQRVQCAQQ

SEQ ID NO: 14291 - protein, 416 aa, Citrus clementina
MFGRAPKKSDNTKYYEILGVSKNASQDDLKKAYRKAAIKNHPDKGGDPEKFKELAQAYEVLSDPEKREIYDQYGEDALKEGMGGGGGAHDPFDIFQSFFGGSPFGGGSSRGRRQRRGEDVIHPLKVSLEDLYNGTSKKLSLSRNVICTKCKGKGSKSGASMKCSGCQGSGMKVSIRHLGPSMIQQMQHPCNECKGTGETINDKDRCPQCKGEKVIQEKKVLEVIVEKGMQNGQKITFPGEADEAPDTVTGDIVFVLQQKEHLKFKRKGDDLFVEHTLSLTEALCGFQFVITHLDGRQLLIKSQPGEVVKPDQFKAINDEGMPMYQRPFMRGKLYIHFTVDFPESLSPDQCKMLETVLPPRTSVQLTDMELDECEETTLHDVNIEEEMRRKQQAAQEAYDEDDDMQGGAQRVQCAQQ

SEQ ID NO: 14292 - protein, 417 aa, Tabernaemontana elegans
MFGRGPKKSDNTKYYEILGVSKNASQDDLKKAYRKAAIKNHPDKGGDPEKFKELAQAYEVLSDPEKRDIYDQYGEDALKEGMGGGGGVHDPFDIFQSFFGGSPFGGGGSSRGRRQRRGEDVIHPLKVSLEDLYNGTSKKLSLSRNVLCQKCKGKGSKSGASMKCSGCQGSGMKVSIRHLGPSMIQQMQHPCNECKGTGETINDKDRCPQCKGEKVVQEKKVLEVIVEKGMQNGQKITFPGEADEAPDTVTGDIVFVLQQKEHPKFKRKGDDLFVEHTLSLTEALCGFQFILTHLDNRQLLIKSQPGEVIKPDQFKAINDEGMVIYQRPFMRGKLYIHFHVEFPDSLTPDQCKALEAVLPPRPTKQITEMELDECEETTLHDVNIEEEMRRKNQQAQEAYEEDEDMHGGAQRVQCAQQ

SEQ ID NO: 14293 - protein, 413 aa, Citrullus lanatus
MFGRPKKSDNTKYYEILGVSKNASQDDLKKAYRKAAIKNHPDKGGDPEKFKELAQAYEVLSDPEKREIYDQYGEDALKEGMGGGGGHDPFDIFQSFFGGSPFGGGGSSRGRRQRRGEDVIHPLKVSLEDLYNGTSKKLSLSRNVICSKCKGKGSKSGASMKCPGCQGSGMKVSIRHLGPSMIQQMQHPCNECKGTGETINDKDRCSQCKGEKVVQEKKVLEVIVEKGMQNGQKITFPGEADEAPDTVTGDIVFVLQQKEHPKFKRKGDDLFVEHTLSLVESLCGFQFILTHLDGRQLLIKTLPGVVVKPDQFKAINDEGMPMYQRPFMKGKLYIHFSVEFPDSLNPEQCKALEGVLPPRTSVQLSDMELDECEETTLHDVNIEEEMRRKQVQEAYDEDDDMHGGAQRVQCAQQ

SEQ ID NO: 14294 - protein, 417 aa, Euphorbia esula
MFGRAPKKSDNSKYYEILGVSKSASQDDLKKAYRKAAIKNHPDKGGDPEKFKELAQAYEVLSDPEKRDIYDQYGEDALKEGMGGGGGGHDPFDIFQSFFGGSPFGGGGSSRGRRQRRGEDVTHPLKVSLEDLYNGTSKKLSLSRNVICSKCKGKGSKSGASMKCSGCQGSGMKVSIRHLGPSMIQQMQHPCNECKGTGETINDKDRCPQCKGEKVIQEKKVLEVHVEKGMQNGQKITFPGEADEAPDTVTGDIVFILQQREHPKFKRRGDDLVVEHTLSLTEALCGFQFILTHLDGRQLLIKSQPGEVVKPDQFKAINDEGMPMYQRPFMRGKLYIHFNVEFPDSLPPDQSKALEAVLPSRTSVQLSDMEVDECEETTLHDVNFEEEMRRKQQQSAEAYDEDEDMPGGAQRVQCAQQ

SEQ ID NO: 14295 - protein, 413 aa, Cucumis melo
MFGRPKKSDNTKYYEILGVSKNASQDDLKKAYRKAAIKNHPDKGGDPEKFKELAQAYEVLSDPEKREIYDQYGEDALKEGMGGGGGHDPFDIFQSFFGGSPFGGGGSSRGRRQRRGEDVIHPLKVSLEDLYNGTSKKLSLSRNVICSKCKGKGSKSGASMKCPGCQGSGMKVSIRHLGPSMIQQMQHPCNECKGTGETINDKDRCSQCKGEKVVQEKKVLEVIVEKGMQNAQKITFPGEADEAPDTVTGDIVFVLQQKEHPRFKRKGDDLFVEHTLSLVESLCGFQFILTHLDGRQLLIKSLPGEVVKPDQFKAINDEGMPMYQRPFMKGKLYIHFSVEFPDSLNPEQCKALEGVLPPRTSVQLSDMELDECEETTLHDVNIEEEMRRKQVQEAYDEDEDMHGGAQRVQCAQQ

SEQ ID NO: 14296 - protein, 420 aa, Arnica chamissonis
MFGRAPKKSDNTKYYEILGVPKNASHDDLKKAYRKAAMQNHPDKGGDPEKFKELAQAYEVLSDPEKREIYDQYGEDALKEGMGGGGGGHDPFDIFQSFFGGSPFGGGGGGSSRGRRQRRGEDVVHPLKVSLEDLYNGTSKKLSLSRNVICSKCKGKGSKSGASMKCSGCQGSGMKVSIRHLGPSMIQQMQHPCNECKGTGETINDKDRCTQCKGEKVVQEKKVLEVHVEKGMLNGQKITFPGEADEAPDTVTGDIVFVLQQKEHPKFKRKGDDIFVEHTLSLTESLCGFQFILTHLDNRQLLIKSEPGVVVKPDQFKAINDEGMPMYQRPFMRGKLYIHFTVEFPDSLSPEQCKALEAVLPPKPSMQMTDMELDECEETTLHDVNIEEEMRRKQQAAQEAYDEDEDMHGGGAQRVQCAQQ

SEQ ID NO: 14297 - protein, 419 aa, Setaria italica
MFGRAPKKSDNTKYYEILGVPKSASQDDLKKAYRKAAIKNHPDKGGDPEKFKELAQAYEVLSDPEKREIYDQYGEDALKEGMGGGGGHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQTACNECKGTGESINEKDRCPGCKGEKVVQEKKVLEVHVEKGMQHGQKITFPGEADEAPDTTTGDIVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEAVLPPKPTSKLTDMEIDECEETTMHDVNNIEEEMRRKQAHAAQEAYEEDDDMPGGAQRVQCAQQ

SEQ ID NO: 14298 - protein, 418 aa, Zingiber officinale
MFGRVPKKSDNTRYYEVLGVPKSASQDDMKKAYRKAAIKNHPDKGGDPEKFKELAQAYEVLSDPEKREIYDQYGEDALKEGMGGGGGGHDPFDIFQSFFGGSPFGGGGSSRGRRQRKGEDVIHPLKVSLEDLYNGISKKLSLSRNVICRKCNGKGSKSGASMTCSGCRGSGMKVSIRQLGPGMIQQMQHVCNDCKGTGEKINEKDRCPNCKGEKVAPEKKVLDVIVEKGMQNGQKISFPGEADEAPDTVTGDIVFVLQQKEHPKFKRKGEDLFYEHSLSLTEALCGFQFVLNHLDGRQLLIKSNPGEVIKPDQYKAINDEGMPIYQRPFMKGKLYIHFAVDFPDSLARDQCKALEAVLPPRSASQLTDMELDECEETTLHDVNIEEEMRRKQTQAQEAYEEDEDDFHGGAQRVQCAQQ

SEQ ID NO: 14299 - protein, 419 aa, Solanum phureja
MFGRAPKKSDNTKYYEILGVPKAASQEDLKKAYRKAAIKNHPDKGGDPEKFKELAQAYEVLSDPEKREIYDQYGEDALKEGMGGGGGGHDPFDIFQSFFGGGGSPFGGGGSSRARRQRRGEDVIHPLKVSLEDLYNGTSKKLSLSRNVLCSKCKGKGSKSGASMKCSGCQGSGMKVSIRQLGPSMIQQMQHPCNECKGTGETISDKDRCPQCKGEKVVQEKKVLEVHVEKGMQNGQKVTFPGEADEAPETITGDIVFVLQQKEHPKFKRKGDDLFVEHTLTLTEALCGFQFVLTHLDNRQLLIKSQPGEVVKPDQFKAINDEGMPMYQRPFMRGKMYIHFTVDFPESLTPEQCKNLEAVLPPRPKLQVSDMELDECEETTLHDVNIEDEMRRKQQAAQEAYDEDDDMPGGAQRVQCAQQ

SEQ ID NO: 14300 - protein, 420 aa, Artemisia annua
MFGRAPKKSDNTKYYEVLGVPQSASADELKKAYRKAAIKNHPDKGGDPEKFKELAQAYEVLSDPEKREIYDQYGEDALKEGMGGGGGGHDPFDIFQSFFGGGGSPFGGGSSRGRRQRRGEDVVHPLKVSLEDLYNGTSKKLSLSRSVLCSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDIFVEHTLSLTEALCGFQFILTHLDNRQLLIKSQPGEVVKPDQFKAINDEGMPMYQRPFMRGKLYIHFTVEFPESLSPEQCKALEAVLPPRPSMQMTDMELDECEETTLHDVNIEEEMRRKQQQAQQEAYDEDDDMHGGGAQRVQCAQQ

SEQ ID NO: 14301 - protein, 420 aa, Brachypodium distachyon
MFGRAPKKSDNTKYYEILGVPKNASQDDLKKAYRKAAIKNHPDKGGDPEKFKELAQAYEVLSDPEKREIYDQYGEDALKEGMGGGGGGVDPFDIFSSFFGPSFGGGGGSSRGRRQRRGEDVIHPLKASLEDLYNGTSKKLSLSRNVLCSKCKGKGSKSGASMRCPGCQGSGMKVTIRQLGPSMIQQVQHACNECKGTGESINEKDRCQGCKGEKVVQEKKVLEVHVEKGMQHNQKITFPGEADEAPDTVTGDIVFVVQQKEHPKFKRKGDDLFYEHTLSLTEALCGFQLVLTHLDNRQLLIKSNPGEIVKPDSFKAISDEGMPMYQRPFMKGKLYIHFTVEFPDSLAPEQCKALEAVLPPKPVSKLTDMELDECEETTLHDVNNMEEEMRRKAQAAAQEAYDEDDDMPGGGAQRVQCAQQ

SEQ ID NO: 14302 - protein, 419 aa, Sorghum bicolor
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQQPCNECKGTGESINEKDRCPGCKGEKVVQEKKVLEVHVEKGMQHNQKITFPGEADEAPDTVTGDIVFVLQQKDHSKFKRKGEDLFYEHTLSLTEALCGFQFVLTHLDNRQLLIKSNPGEVVKPDQFKAINDEGMPIYQRPFMKGKLYIHFTVEFPDSLAPEQCKALEAVLPPRSSSKLTDMEIDECEETTMHDVNNIEEEMRRKQAHAAQEAYEEDDEMPGGAQRVQCAQQ

SEQ ID NO: 14303 - protein, 120 aa, Musa acuminata
MFGRAPKKSDNTKYYEILGVPKNASQEDLKKAYRKAAIKNHPDKGGDPEKFKELAQAYEVLSDPEKREIYDQYGEDALKEGMGGWRWPQPIRYLRVVLRWKSLRRRRKQSRTKAEEGGRM

SEQ ID NO: 14304 - protein, 416 aa, Aquilegia formosa
MFGRPPKKSDNTKYYEILGVAKNASPEDLKKAYKKAAIKNHPDKGGDPEKFKELAQAYEVLSDPEKRDLYDQYGEDALKDPGMGGGGGHDPFDIFSSFFGGSPFGGGSSRGRRQRRGEDVVHPLKVSLEDLYSGTSKKLSLSRNVLCSKCSGKGSKSGASMKCPGCQGSGMKVSIRQLGPGMIQQMQHPCNECKGTGESINEKDRCPSCKGEKVVTEKKVLEVHVEKGMQNGQKITFPGEADEAPDTITGDIVFVLQQKDHPKFKRKGDDLFVEHTLSLTEALCGFQFIITHLDGRQLLIKSQPGEVVKPDQFKAVNDEGMPMYQRPFMRGKLYIHFTVDFPDSLTPEQCKALEAVLPPKTATQMTDMELDECEETTLHDVNIEEEMRRKQAAQHEAYDEDDEMPGGAQRVQCAQQ

SEQ ID NO: 14305 - protein, 417 aa, Euphorbia peplus
MFGRAPKKSDNSKYYEILGVSKSASQDDLKKAYRKAAIKNHPDKGGDPEKFKELAQAYEVLSDPEKRDIYDQYGEDALKEGMGGGGGGHDPFDIFQSFFGGSPFGGGGSSRGRRQRRGEDVTHPLKVSLEDLYNGTSKKLSLSRNVICSKCKGKGSKSGASMKCSGCQGSGMKVSIRHLGPSMIQQMQHPCNECKGTGETINDKDRGPQCKGEKVIQEKKVLEVHVEKGMQNGQKITFPGEADEAPDTVTGDIVFILQQREHPKFKRRGDDLVVEHTLSLTEALCGFQFILTHLDGRQLLIKSQPGEVVKPDQFKAINDEGMPMYQRPFMRGKLYIHFNVEFPDSLPPDQSKALEAVLPSRTSVQLSDMEVDECEETTLHDVNFEEEMRRKQQQSAEAYDEDEDMPGGAQRVQCAQQ

SEQ ID NO: 14306 - protein, 407 aa, Brassica napus
MFRRGPSSKSDNTKFYEILGVPKSASPEDLKKAYKRAAIKNHPDKGGDPEKFKELGEAYGVLSDPEKREIYDQYGEEGLKDGIDRHDPFDIFSSFFGRNERRQRRGEDVVHPLRVSLEDLYLGTTKKLSLSRNALCSKCSGKGSKSGASLKCGGCQGKGMKVSIRQIGPGMIQQMQHVCQDCKGTGETINDRDRCPQCKGDKVIPEKKVLDVAVEKGMQNSQKITFRGQADEAPDTVTGDIVFVIQQKEHPKFKRKGNDLFVEHTLSLTEALCGFQFVLTHLDARQLLIKSSPGEVVQPDSYKAISDEGMPMHQRPFMKGKLYIHFTVEFPESLSGDQTKAFEAVLPKPAEFALSDMEIAECEETTLHEVNIEAEMKRKAQAKREAYDDDDEEEGPGGGHGVQCAQQ

SEQ ID NO: 14307 - protein, 407 aa, Brassica napus
MFRRGPSSKSDNTKFYEILGVPKSASPEDLKKAYKRAAIKNHPDKGGDPEKFKELGEAYGVLSDPEKREIYDQYGEEGLKDGIDRHDPFDIFSSFFGRNERRQRRGEDVVHPLRVSLEDLYLGTTKKLSLSRNALCSKCSGKGSKSGASLKCGGCQGKGMKVSIRQIGPGMIQQMQHVCQDCKGTGETINDRDRCPQCKGDKVIPEKKVLDVAVEKGMQNSQKITFRGQADEAPDTVTGDIVFVIQQKEHPKFKRKGNDLFVEHTLSLTEALCGFQFVLTHLDARQLLIKSSPGEVVQPDSYKAISDEGMPMHQRPFMKGKLYIHFTVEFPESLSGDQTKAFEAVLPKPAESALSDMEIDKCEETTLHEVNIEAEMKRKAQAKREAYDDDDEEEGPGGGHGVQCAQQ

SEQ ID NO: 14308 - protein, 417 aa, Coffea canephora
MFGRAPKKSDNTRYYEILGVSKNASPEDLKKAYKKAAIKNHPDKGGDPEKFKELAHAYEVLSDPEKREIYDQYGEDALKEGMGGGGGMHDPFDIFQTFFNGDPFNRGSSRGRRQRRGEDVVHPLKVSLEDLYSGTTKKLSLSRNVICTKCSGKGSKSGASTKCSGCQGTGMKVTIRQLGPGMIQQMQHPCNECKGTGETINDKDRCPLCKGEKVVPEKKVLEVHVEKGMQNGQKITFPGEADEAPDTATGDIVFVVQQKEHPKLKRKHDDIFVEHTLSLTEALCGFQFILTHLDGRQLLIKSKPGEVIKPDQFKAIDDEGMPMYQRPFMRGKMYIHFTVEFPDSLSPDQVKALEGILPPKPQSQLTDMELDECEETTLHDVNIEEEMRRKQAAQQEAYEEDDDMHGGGAQRVQCAQQ

SEQ ID NO: 14309 - protein, 416 aa, Coffea canephora
MFGRAPKRSDNTKYYEVLGVSKNASQDDLKKAYRKAAIKNHPDKGGDPEKFKELAQAYEVLSDPEKREIYDQYGEDALKEGMGGGGGVHDPFDIFQSFFGGSPFGGGGSSRGRRQRRGEDVIHPLKVSLEDLYNGTSKKLSLSRNVLCPKCKGKGSKSGASMKCSGCQGSGMKVSIRQLGPSMIQQMQHPCNECKGTGETINDKDRCPQCKGEKVVQEKKVLEVVVEKGMQNGQKITFPGEADEAPDTVTGDIVFVLQQKEHPKFKRKHDDLFYEHTLSLTEALCGFQFILTHLDGRQLLIKSQPGEVVKPDQFKAINDEGMVVYQRPFMRGKLYIHFNVEFPDYLDPEQCKSLEAVLPPKTTKQITDMELDECEETTLHDVNIEDEMRRKQQAQEAYEEDEDMHGGAQRVQCAQQ

SEQ ID NO: 14310 - protein, 419 aa, Cannabis sativa
MFGRAPKKSDNTKYYEVLGVSKNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVIHPLKVSLEDLYNGTSKKLSLSRNVLCSKCKGKGSKSGASMKCPVCQGSGMKISIRQLGPSMIQQMQHPCNDCKGTGETINDKDRCTQCKGEKVVQEKKVLEVNVDKGMQNGQRITFPGEADEAPDTVTGDIVFILQQKEHPKYKRKGDDIFYEHTLSLTEALCGFQFILTHLDGRQLLIKSQPGEVVKPDQFKAINDEGMPMYQRPFMKGKLYIHFTVEFPDSLSPEQCKALETVLPPRAGAQLTDMEIDECEETTMHDVNIEEEMRRKQAQSQEAYDEDDDMHGGGAQRVQCAQQ

SEQ ID NO: 14311 - protein, 411 aa, Cicer arietinum
IGRPGRYYEILGVSKNASQDDLKKAYKKAAIKNHPDKGGDPEKFKELAQAYEVLSDPEKREIYDTYGEDALKEGMGGGGGGHDPFDIFSSFFGGNHFGGGGGSRGRRQRRGEDVVHPLKVSLEDLYLGTSKKPSLSRNVLCSKCSGKGSKSGASMKCAGCQGTGVKVSIRHLGPSMIQQMQHPCNECKGTGETINDKDRCPQCKGGKVVQEKKVLEVHVEKGMQNSQKITFPGEADEAPDTVTGDIVFVLQQKEHPKFKRKSEDLFVEHTLSLTEALCGFQFALTHLDGRQLLIKSNPGEVVKPDSFKAINDEGMPMYQRPFMKGKLYIHFTVEFPETLSLDQVKGLEAVLPAKPSSQLTDMELDECEETTLHDVNMEEETRRKQHQQQQEAYDEDDDMPGGAQRVQCAQQ

SEQ ID NO: 14312 - protein, 422 aa, Hordeum vulgare
MFGRAPKKSDNTKYYEVLGVPKDAAQDDLKKAYRKAAIKNHPDKGGDPEKFKELAQAYEVLSDPEKREIYDKYGEDALKEGMGGGGGGGVDPFDIFSSFFGPSFGGGGGGSSRGRRQRRGEDVVHPLKASLEDLYNGTSKKLSLSRSVLCSKCKGKGSKSGASMRCPGCQGSGMKVTIRQLGPSMIQQVQHACNDCKGTGESINDKDRCPGCKGEKVLQEKKVLEVHVEKGMQHNQKITFPGEADEAPDTVTGDIVFVVQQKEHPKFKRKGDDLFYEHTISLTEALCGFQLVLTHLDNRQLLIKSNPGEVVKPDSFKAISDEGMPMYQRPFMKGKLYIHFTVEFPDSLAPDQCKALEAVLPPKPASKLTDMELDECEETTMHDVNMEEEMRRKAHAAAQEAYDEDDDEMPGGGAQRVQCAQQ

SEQ ID NO: 14313 - protein, 417 aa, Oryza sativa
MFGRAPKKSDNTKYYEILGVPKTASQDDLKKAYRKAAIKNHPDKGGDPEKFKELAQAYEVLSDPEKREIYDQYGEDALKEGMGGGGSHVDPFDIFSSFFGPSFGGGGSSRGRRQRRGEDVIHPLKVSLEDLYNGTSKKLSLSRNVLCAKCKGKGSKSGASMRCPGCQGSGMKITIRQLGPSMIQQMQQPCNECKGTGESINEKDRCPGCKGEKVIQEKKVLEVHVEKGMQHNQKITFPGEADEAPDTVTGDIVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEAVLPPKPASQLTEMEIDECEETTMHDVNNIEEEMRRKAQAAQEAYDEDDEMPGGAQRVQCAQQ

SEQ ID NO: 14314 - protein, 419 aa, Zea mays
MFGRAPKKSDNTKYYEILGVPKSASQDDLKKAYRKAAIKNHPDKGGDPEKFKELAQAYEVLSDPEKREIYDQYGEDALKEGMGGGGSHADPFDIFSSFFGPSFGGGGGSSRGRRQRRGEDVVHSLKVSLEDLYNGISKKLSLSRNVICSKCKGKGSKSGASMRCPGCQGSGMKVTIRQLGPSMIQQMQQPCNECKGTGESINEKDRCPGCKGEKVVQEKKVLEVHVEKGMQHSQKITFPGEADEAPDTVTGDIVFVLQQKDHSKFKRKGEDLFYEHTLSLTEALCGFQFVLTHLDNRQLLIKSNPGEVVKPDQFKAINDEGMPIYQRPFMKGKLYIHFTVEFPDSLAPEQCKALESVLPPKPSSKLTDMEIDECEETTMHDVNNIEEEMRRKQAHAAQEAYEEDDEMPGGAQRVQCAQQ

SEQ ID NO: 14315 - protein, 193 aa, Ambrosia trifida
MFGRAPKKSDNTKYYEILGVPKTASQDDLKKAYRKAAIKNHPDKGGDPEKFKELAQAYEVLSDPEKREIYDQYGEDALKEGMGGGGGGHDPFDIFQSFFGGGSPFGGGGGSSRGRRQRRGEDVVHPLKVSLEDLYNGTSKKLSLSRNVICSKCKGKGSKSGASMKCAGCQGSGMKVSIRHLGPSMIQQMQHTL

SEQ ID NO: 14316 - protein, 279 aa, Phalaenopsis aphrodite
MFGRAPKKSDNTRYYEILGVSKSASQDDLKKAYRKAAIKNHPDKGGDPEKFKELAQAYEVLSDPEKRDIYDQYGEDALKEGMGGGGAGHDPFDIFQSFFGGNPFGGGGSSRGRRQRRGEDVVHPLKVTLEDLYNGTSKKLSLSRNVLCSKCKGKGSKSGASMKCSGCQGTGMKVSIRQLGPSMIQQMQHPCNECKGTGETINDKDRCPQCKGEKVTQEKKVLDVLVEKGMQNGQEITSPVRLMRRLIVSLATSYLSCNKRTTLSSKERATISLWSTHSP

SEQ ID NO: 14317 - protein, 418 aa, Triphysaria pusilla
MFGRAPTKSDNTKYYEVLGVPKTASPDDLKKAYKKAAIKNHPDKGGDPEKFKELAHAYEVLSDPEKREIYDQYGEDALKEGMGGGGGGHDPFDIFSSFFGGGFGGGGSSRGRRQRRGEDVVHPLKVSLEDLYLGTTKKLSLSRNVLCVKCNGKGSKSGASMTCSGCQGSGMKVTMRQLGPGMIQQMQQHCNDCRGTGETIDNKDRCPQCKGAKVVPEKKALEVHVEKGMQNGQKITFPGEADEAPDTVTGDIVFVLQQKEHPKFKRKGDDLFVEHPLTLTEALCGFQFILSHLDGRHLLIKSLPGEVVKPDSFKAINDEGMPMYQRPFMKGKLYIHFNVEFPDSLNPDQIDALAKILPAKPESQLTEMELDECEETTLHDVNIEEEMRRKQAQQRQEAYDQDEEMHGGGAQRVQCAQQ

SEQ ID NO: 14318 - protein, 418 aa, Gossypium hirsutum
MFGRAPKKSDNSKYYEILGVSKNASQDDLKKAYRKAAIKNHPDKGGDPEKFKELAQAYEVLSDPEKREIYDQYGEDALKEGMGSGGGGHDPFDIFQSFFGGNPFGAGGSSRGRRQRRGEDVIHPLKVSLEDLYNGTSKKLSLSRNVICSKCKGKGSKSGASMKCSGCQGSGMKVSIRHLGPSMIQQMQHPCNECKGTGETINDKDRCPQCKGDKVVQEKKVLEVIVEKGMQNGQRITFPGEADEAPDTVTGDIVFVLQQKDHPKFKRKGDDLFVEHTLALTEALCGFQFILTHLDGRQLLIKTQPGEVVKPDQFKAINDEGMPIYQRPFMRGKLFIHFTVDFPDSLTPDQCKALEAVLPPKASVQLTDMELDECEETTMHDVNIEEEMRRKQAQAQQEAYEEDEDMHGGAQRVQCAQQ

SEQ ID NO: 14319 - protein, 415 aa, Populus trichocarpa
MFGRAPKKSDNTRYYEILGVSKNASQDDLKKAYRKAAIKNHPDKGGDPEKFKELAQAYEVLSDPEKREIYDQYGEEALKEGMGGGGAGHNPFDIFESFFGGNPFGGGGSRGRRQRRGEDVVHPLKVSLEDLYLGTSKKLSLTRNVICSKCNGKGSKSGESMKCTGCQGSGMKVSIRQLGPSMIQQMQHPCNECKGTGETISDKDRCPQCKGEKIVPEKKVLEVIVEKGMQNGQKITFPGEADEAPDTVTGDIVFVLQQKEHPKFKRKGDDLFVEHTLPLTEALCGFQFVLTHLDGRQLLIKSNPGEAVKPDSFKAINDEGMPMYQRPFMKGKLYIHFTVDFPDSLTPDQVKAIETILPRPSSQLTDMELDECEETTLHDVNIEEEMRRKQQAREEAYDEDEEMPHGGQRVQCAQQ

SEQ ID NO: 14320 - protein, 418 aa, Gossypium hirsutum
MFGRAPKKSDNTKYYEILGVSKNASQDDLKKAYRKAAIKNHPDKGGDPEKFKELAQAYEVLSDPEKREIYDQYGEDALKEGMGSGGGGHDPFDIFQSFFGGNPFGAGGSSRGRRQRRGEDVIHPLKVSLEDLYNGTSKKLSLSRNVICSKCKGKGSKSGASMKCTGCQGSGMKVSIRHLGPSMIQQMQHPCNECKGTGETINDKDRCPQCKGDKVVQEKKVLEVIVEKGMQNGQRITFPGEADEAPDTVTGDIVFVLQQKDHPKFKRKGDDLFVEHTLALTEALCGFQFILTHLDGRQLLIKTQPGEVVKPDQFKAINDEGMPIYQRPFMRGKLYIQFTVDFPDSLTPDQCKALEAVLPPKASVQLTDMELDECEETTLHDVNIEEVMRRKQTQAQQEAYDEDEDMHGGAQRVQCAQQ

SEQ ID NO: 14321 - protein, 416 aa, Gossypium hirsutum
MFGRAPKKSDNTRYYEILGVSKNASHDDLKKAYKKAAIKNHPDKGGDPEKFKELAQAYEVLSDPEKREIYDQYGEDALKEGMGGGAAAHDPFDIFSSFFGGSPFGGASSRGRRQRRGEDVVHPLKVSLEDLYLGTSKKLSLSRNVICSKCSGKGSKSGASMQCPGCQGSGMKISVRHLGPSMIQQMQHPCNECKGTGETINDKDRCPQCKGEKVVQEKKVLEVIVEKGMQNGQKITFPGEADEAPDTITGDIVFVLQQKDHPKFKRKGEDLFVEHTLALTEALCGFQFVVTHLDGRQLLIKSIPGEVVKPDSFKAINDEGMPLYQRPFIKGKMYIHFTVEFPDSLNPDQIMALEAILPPKPTSHLTDMELDECEETTLHDVNIEEEMRRKQQAAQEAYDEDEDTHGGAQRVQCAQQ

SEQ ID NO: 14322 - protein, 336 aa, Platanus occidentalis
MGGGAGGHDPFDIFQSFFGGSPFGGGGSSRGRRQRRGEDVIHPLKVSLEDLYSGTSKKLSLSRNIICSKCKGKGSKSGASMTCSGCQGSGMKVSIRHLGPSMIQQMQHACNECKGTGETINDKDRCPQCKGEKVVQEKKVLDVVVEKGMQNSQKITFPGEADEAPDTVTGDIVFVLQQKEHPKFKRKGDDLFVEHTLSLTEALCGFQFILTHLDNRQLLIKSNPGEVVKPDQFKAINDEGMPMYQRPFIKGKLYIHFTVEFPESMTAEQCKALEAVLPPRTSMQLTDMELDECEETTLHDVNIEEEMRRKQAQAQEAYEEDDDLHGGAQRVQCAQQ

SEQ ID NO: 14323 - protein, 336 aa, Juglans hindsii x Juglans regia
MGGGGGGHDPFDIFQSFFGGNPFGGGGSSRGRRQRRGEDVVHPLKVSLEDLYNGTSKKLSLSRNAICSKCKGKGSKSGASMKCSGCQGSGIKVSIRHLGPSMIQQMQHACNECKGTGETINDKDRCPQCKGEKVVQEKKVLEVIVEKGMQNGQKITFPGEADEAPDTVTGDIVFVLQQKEHPKFKRKGDDLFVEHTLSLTEALCGFQFILMHLDGRQLLIKSEPGEVVKPDQYKGINDEGMPMYQRSFMKGKLYIHFAVEFPDTLSPEQCKTLEAVLPPRSSVQLTDMELDECEETTLHDVNLEEEMRRKQAQAQEAYDEDEDMPGGAQRVQCAQQ

SEQ ID NO: 14324 - protein, 419 aa, Zea mays
MFGRAPKKSDNTKYYEILGVPKSASQDDLKKAYRKAAIKNHPDKGGDPEKFKELAQAYEVLSDPEKREIYDQYGEDALKEGMGGGGSHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQQPCNECKGTGESINEKDRCPGCKGEKVIQEKKVLEVHVEKGMQHNQKITFPGEADEAPDTVTGDIVFVLQQKDHSKFKRKGEDLFYEHTLSLTEALCGFQFVLTHLDNRQLLIKSDPGEVVKPDQFKAINDEGMPIYQRPFMKGKLYIHFTVEFPDSLAPEQCKALETVLPPRPSSKLTDMEIDECEETTMHDVNNIEEEMRRKQAHAAQEAYEEDDEMPGGAQRVQCAQQ

SEQ ID NO: 14325 - protein, 419 aa, Pennisetum glaucum
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQTACNECKGTGESINEKDRCPGCKGEKVVQEKKVLEVHVEKGMQHNQKITFPGEADEAPDTVTGDIVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEVVLPPKPTSKLTDMEIDECEETNMHDVNNIEEEMRRKQAHAAQEAYDEDDEMPGGAQRVQCAQQ

SEQ ID NO: 14326 - protein, 417 aa, Malus domestica
MFGRAPKKSDNSKYYEILGVSKTASQDDLKKAYRKAAIKNHPDKGGDPEKFKELAQAYEVLSDPEKREIYDQYGEDALKEGMGGGGGGHDPFDIFQSFFGGNPFGGGGSSRGRRQRRGEDVIHPLKVSLEDLYNGTSKKLSLSRNKICSKCKGKGSKSGASMTCPGCQGSGMKVSIRHLGPSMIQQMQHPCNECKGTGESINDKDRCTQCKGEKVVQEKKVLEVIVEKGMQNGQRITFPGEADEAPDTVTGDIVFVLQQKEHPKFKRKGDDLFFEHTLSLMESLCGFQFILTHLDGRQLLIKSHPGEVVKPDQFKAINDEGMPMYQRPFMKGKLYIHFTVEFPDSLNPEQCKALEAVLPPRTSAQLTDMELDECEETTLHDVNIEEEMRRKQAHAQEAYDEDEDMHGGAQRVQCAQQ

SEQ ID NO: 14327 - protein, 418 aa, Catharanthus roseus
MFGRGPKKSDNTKYYEILGVPKNASQDDLKKAYRKAAIKNHPDKGGDPEKFKELAQAYEVLSDPEKRDIYDQYGEDALKEGMGGGGGMHDPFDIFQSFFGGSPFGGGGSSRGRRQRRGEDVIHPLKVSLEDLYNGTSKKLSLSRNVLCQRCKGKGSKSGASMKCSGCQGSGMKVSIRQLGPSMIQQMQHPCNECKGTGETITDKDRCPQCKGEKVVQEKKVLEVIVEKGMQNGQKITFPGEADEAPDTITGDIVFILQQKEHPKFKRKGDDLFYEHTLSLTEALCGFQFILTHLDNRQLLIKSQPGEVIKPDQFKAINDEGMVIYQRPFMRGKLYIHFNVEFPDSLAPEQCKALEAVLPPRPAKQITEMELDECEETTLHDVNIEDEMRRKNQQAQQEAYDEDEDMHGGAQRVQCAQQ

SEQ ID NO: 14328 - protein, 414 aa, Cirsium arvense
APKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGNPFGGGGGSSRGRRQRRGEDVIHPLKVSLEDLYNGTSKKLSLSRNVICSKCKGKGSKSGASMKCAGCQGSGMKVSIRHLGPSMIQQMQHPCNECKGTGETINDKDRCPQCKGEKVVQEKKVLEVHVEKGMQNGQKITFPGEADEAPDTVTGDIVFVLQQKEHPKFKRKGDDIFVEHTLSLTEALCGFQFILTHLDSRQLLIKSQPGEVVKPDQFKAINDEGMPMYQRPFMRGKLYIHFTVEFPDSLSPEQCKALEGVLPARPSMQMTDMELDECEETTLHDVNIEEEMRRKQQAAQEAYDEDEDMHGGAQRVQCAQQ

SEQ ID NO: 14329 - protein, 418 aa, Cirsium arvense
MFGRAPKKSDNTKYYGILGVPQDASQDDLKKAYRKAAIKNHPDKGGDPEKFKELAQAYEVLSDPEKREIYDQYGEDALKEGMGGGGGGHDPFDIFQSFFGGSAFGGGGGSSRGRRQRRGEDVVHPLKVSLEDLYNGTSKKLSLSRNVLCSKCKGKGSKSGASTTCGGCQGSGMKVSIRHLGPSMIQQMQHPCNECKGTGETINDKDRCPQCKGEKVVQEKKMLEVHVEKGMQNGQKITFPGEADEAPDTVTGDIVFVLQQKEHPKFKRKGDDIFVEHTLSLTEALCGFQFILTHLDSRQILIKSQPGEVVKPDQFKAINDEGMPMYQRPFMRGKLYIHFTVEFPDSLTPEQCKALEGVLPARPSMQMTDMELDECEETTLHDVNIEEEMRRKQHAAQEAYDEDEDMHGGAQRVQCAQQ

SEQ ID NO: 14330 - protein, 418 aa, Curcuma longa
MFGRVPKKSDNTRYYEILGVQKSASQDDMKKAYRKAAIKNHPDKGGDPEKFKELAQAYEVLSDPEKREIYDQYGEDALKEGMGGGGGGHDPFDIFQSFFGGSPFGGGGSSRGRRQRKGEDVIHPLKVSLEDLYNGISKKLSLSRNVICRKCNGKGSKSGASMTCSGCRGSGMKVSIRQLGPGMIQQMQHVCNDCKGTGEKINEKDRCSNCKGEKVAPEKKVLDVIVEKGMQNGQKISFPGEADEAPDTVTGDIVFVLQQKEHPKFKRKGEDLFYEHSLSLTEALCGFQFVLNHLDGRQLLIKSNPGEVIKPDQYKAINDEGMPIYQRPFMKGKLYIHFAVDFPDSLARDQCRALEAVLPPRSASQLTDMELDECEETTLHDVNIEEEMRRKQTQAQEAYEEDEDDFHGGAQRVQCAQQ

SEQ ID NO: 14331 - protein, 417 aa, Eucalyptus grandis
MFGRAPKKSDNTKYYDVLGVSKNASQDDLKKAYRKAAIKNHPDKGGDPEKFKELAQAYEVLSDPEKREIYDQYGEDALKEGMGGGGGGHDPFDIFQSFFGGSPFGGGGSSRGRRQRRGEDVIHPLKVSLEDLYNGTSKKLALSRNVICSKCKGKGSKSGASIKCVGCQGSGMKVSIRHLGPSMIQQMQHPCNECKGTGETINDKDRCPQCKGEKVVQEKKVLEVIVEKGMQNGQKIKFPGEADEAPDTVTGDIVFVLQQKEHPKYKRKGDDLFYEHTLSLTESLCGFQFALSHLDGRQLLIKSQPGEVIKPDQFKAINDEGMPIYPRPFMKGKLYIHFTVEFPDTLSPEQCKALETILPPRSSAQLTDMELDECEETTLHDVNIEEEMRRKQAQAQEAYEEDEDMHGGAQRVQCAQQ

SEQ ID NO: 14332 - protein, 418 aa, Saccharum officinarum
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSRNVLCSKCNGKGSKSGASSRCAGCQGSGFKVQIRQLGPGMIQQMQHPCNECKGSGETINDKDRCPQCKGDKVVQEKKVLEVVVEKGMQNGQKITFPGEADEAPDTVTGDIIFVLQQKEHPKFKRKGDDLFYEHTLTLTESLCGFQFVLTHLDNRQLLIKSNPGEVVKPDSFKAINDEGMPMYQRPFMKGKLYIHFSVDFPDSLSPEQCKALEAVLPPKPVSQYTDMELDECEETMPYDVNIEEEMRRRQQQHQEAYDEDEDMPGGAQRVQCAQQ

SEQ ID NO: 14333 - protein, 419 aa, Solanum lycopersicum
MFGRAPKKSDNTKYYEILGVPKAASQEDLKKAYRKAAIKNHPDKGGDPEKFKELAQAYEVLSDPEKREIYDQYGEDALKEGMGGGGGGHDPFDIFQSFFGGGGNPFGGGGSSRARRQRRGEDVIHPLKVSLEDLYNGTSKKLSLSRNVLCSKCKGKGSKSGASMKCSGCQGSGMKVSIRQLGPSMIQQMQHPCNECKGTGEMISDKDRCPQCKGEKVVQEKKVLEVHVEKGMQNGQKVTFPGEADEAPDTITGDIVFVLQQKEHPKFKRKGDDLFVEHTLTLTEALCGFQFVLTHLDNRQLLIKSQPGEVVKPDQFKAINDEGMPMYQRPFMRGKMYIHFTVDFPESLTAEQCKNLEAVLPPKPKLQVSDMELDECEETTLHDVNIEDEMRRKQQAAQEAYDEDDDMPGGAQRVQCAQQ

SEQ ID NO: 14334 - protein, 420 aa, Populus trichocarpa
MFGRAPKKSDNTKYYEVLGVSKSASQDDLKKAYRKAAIKNHPDKGGDPEKFKELAQAYEVLSDPEKREIYDQYGEDALKEGMGGGGSGAHDPFDIFQSFFGGGNPFGGGGSSRGRRQRRGEDVIHPLKVSFEDIYNGTSKKLSLSRNVICSKCKGKGSKSGASSKCAGCQGSGMKVSIRHLGPSMIQQMQHPCNECKGTGETINDKDRCPQCKGEKVAQEKKVLEVVVEKGMQNGQRITFPGEADEAPDTVTGDIVFVLQQKDHPKFKRKGDDLFVEHTLSLTEALCGFHFVLTHLDGRQLLIKSQPGEVVKPDQFKAINDEGMPMYQRPFMRGKLYIHFSVDFPDSLSTDQCKALEAVLPPRASVQLTDMELDECEETTLHDVNIEEEMRRKQQQQAQEAYDEDDEMPGGAQRVQCAQQ

SEQ ID NO: 14335 - protein, 420 aa, Capsicum annuum
MFGRAPKKSDNTKYYDILGVQKSASQDDLKKAYRKAAIKNHPDKGGDPEKFKEIAQAYDVLSDPEKREIYDQYGEDALKEGMGGGGGGHDPFDIFQSFFGGGGSPFGGGGSSRGRRQRRGEDVIHPLKVSLEDLYNGTSKKLSLSRNVLCSKCKGKGSKSGASMKCSGCQGSGMKVSIRQLGPSMIQQMQHPCNECKGTGETISDKDRCPQCKGEKVVQEKKVLEVHVEKGMQNGQKVTFPGEADEAPETITGDIVFVLQQKEHPKFKRKGDDLFVEHTLTLTEALCGFQFVLTHLDNRQLLIKSQPGEVVKPDQFKAINDEGMPMYQRPFMRGKLYIHFTVDFPESLTPEQCKNLEAVLPPKPKQQVSDMELDECEETTLHDVNIEDEMRRKQQAAQEAYDEDDDMHGGGAQRVQCAQQ

SEQ ID NO: 14336 - protein, 208 aa, Cucurbita pepo
MGGGGGHDPFDIFQSFFGGSPFGGGGSSRGRRQRRGEDVIHPLKVSLEDLYNGTSKKLSLSRNVICSKCKGKGSKSGASMNCPGCQGSGMKVSIRHLGPSMIQQMQHPCNECKGTGETINDKDRCSQCKGEKVVQEKKVLEVVVEKGMQNGQKITFPGEADEAPDTLTGDIVFVLQQKSTRSLRERAMTSSWSIPCLSSSPFAVSSLF

SEQ ID NO: 14337 - protein, 417 aa, Malus domestica
MFGRAPKKSDNSKYYEILGVSKTASQDDLKKAYRKAAIKNHPDKGGDPEKFKELAQAYEVLSDPEKREIYDQYGEDALKEGMGGGGGGHDPFDIFQSFFGGNPFGGGGSSRGRRQRRGEDVIHPLKVSLEDLYNGTSKKLSLARNKICSKCKGKGSKSGASMKCPGCQGSGMKVSIRHLGPSMIQQMQHPCAECKGTGETINDKDRCTQCKGEKVVQEKKVLEVIVEKGMQNGQKITFPGEADEAPDTITGDIVFVLQQKEHPKFKRKGDDLFFEHTLSLVESLCGFQFVLTHLDGRQLLIKSQPGEVVKPDQFKAINDEGMPMYQRPFMKGKLYIHFTVEFPDSLNPEQCKALEAVLPPKTSAQLTDMELDECEETTLHDVNIEEEMRRKQAHAHEAYDDDEDMHGGAQRVQCAQQ

SEQ ID NO: 14338 - protein, 417 aa, Nicotiana tabacum
MFGRTPKKSDSTKYYEILGVPKSASQDDLKKAYRKAAIKNHPDKGGDPEKFKELAQAYEVLSDPEKRDIYDQYGEDALKEGMGGGGGGHDPFDIFQSFFGGSPFGGGGSSRGRRQRKGEDVVHPLKVSLEDVYNGTSKKLSLSRNVLCAKCKGKGSKSGASMKCSGCQGSGMKVSIRQLGPSMIQQMQHPCNECKGTGETINDKDRCPQCKGEKVVQEKKVLEVHVEKGMQNGQKITFPGEADEAPETITGDIVFILQQKEHPKFKRKGDDLFVEHTLTLTEALCGFQFILTHLDNRQLLIKSQPGEVVKPDQFKAINDEGMPMYQRPFMRGKLYIHFTVDFPESLTPEQCKNLEAVLPPKPKMEVSEMELDECEETTLHDVNIEEEMRRKQQAAQEAYDDDDDMPGGAQRVQCAQQ

SEQ ID NO: 14339 - protein, 421 aa, Triticum aestivum
MFGRAPKKSDNTKYYEVLGVPKNAAQDDLKKAYRKAAIKNHPDKGGDPEKFKELAQAYEVLSDPEKREIYDQYGEDALKEGMGGGGGGGVDPFDIFSSFFGPSFGGGGGGSSRGRRQRRGEDVVHPLKASLEDLYNGTSKKLSLSRSVLCSKCKGKGSKSGASMRCPGCQGSGMKVTIRQLGPSMIQQMQQACNDCKGTGESINDKDRCPGCKGEKVLQEKKVLEVHVEKGMQHNQKITFPGEADEAPDTVTGDIVFVVQQKEHPKFKRKGDDLFYEHTISLTEALCGFQLVLTHLDNRQLLIKSNPGEIVKPDSFKAISDEGMPMYQRPFMKGKLYIHFTVEFPDSLAPDQCKALEAVLPPKPASKLTDMELDECEETTMHDVNMEEEMRRKAHAAAQEAYDEDDEMPGGGAQRVQCAQQ

SEQ ID NO: 14340 - protein, 242 aa, Triticum aestivum
MFGRAPKKSDNTKYYEVLGVPKNAAQDDLKKAYRKAAIKNHPDKGGDPEKFKELAQAYEVLSDPEKREIYDQYGEDALKEGMGGGGGGGVDPFDIFSSFFGPSFGGGGGGSSRGRRQRRGEDVVHPLKASLEDLYNGTSKKLSLSRSVLCSKCKGKGSKSGASMRCPGCQGSGMKVTIRQLGPSMIQQMQQACNDCKGTGESINDKDRCPGCKGEKVLQEKKVLEVHVEKGMQHNPEDHLPW

SEQ ID NO: 14341 - protein, 418 aa, Actinidia deliciosa
MFGRAPKKSDNTKYYEILGVSKSALQDDLKKAYRKAAIKNHPDKGGDPEKFKELAQAYEVLSDPEKREIYDQYGEDALKEGMGGGGGGHDPFDIFQSFFGGSPFGGGGSSRGRRQRKGEDVIHPLKVSLEDLYNGTAKKLSLSRNVICSKCKGKGSKSGASMKCASCQGSGMKVSIRHLGPSMIQQMQHPCNECKGTGETISDKDRCPQCKGEKVVGEKKVLEVVAEKGMQNGQKITFPGEADEAPDTVTGDIVFVLQQKEHPKFKRKGDDLFVEHTLTLTEALCGFHFILTHLDNRQLLIKSQPGEVIKPDSFKGINDEGMPMYQRPFMKGKMYIHFTVDFPESLTPEQSKALEAVLPPKPSMQMSEMELDECEETTLHDVNIEEEMRRKQQQQAQEAYDEDEDMHGGAQRVQCAQQ

SEQ ID NO: 14342 - protein, 422 aa, Populus trichocarpa
MFGRAPKKSDNTKYYEILGVSKSASQDDLKKAYRKAAIKNHPDKGGDPEKFKELAQAYEVLSDPEKREIYDQYGEDALKEGMGGGGGGGAHDPFDIFQSFFGGGNPFGGGGSSRGRRQRRGEDVIHPLKVSLEDIYNGTSKKLSLSRNVICSKCKGKGSKSGASLKCSGCQGSGMKVSIRHLGPSMIQQMQHPCNDCKGTGEAINDKDRCPQCKGEKVVQEKKVLEVVVEKGMQNAQRITFPGEADEAPDTVTGDIVFVLQQKEHPKFKRKGDDLFVEHTLSLAEALCGFQFILTHLDGRQLLIKSQPGEVVKPDQFKAINDEGMPMYQRPFMRGKLYIHFTVDFPDSLSLDQCKALETVLPPRTSAELTDMELDECEETTLHDVNIEEEMRRKQQQQAQEAYDEDDEMHGGGGQRVQCAQQ

SEQ ID NO: 14343 - protein, 191 aa, Cynara scolymus
  misc_feature (167)..(167): Xaa can be any naturally occurring amino acid
MFGRAPKKSDNTKYYEILGVPNNASQDDLKKAYRKAAIKNHPDKGGDPEKFKELAQAYEVLSDPEKREIYDQYGEDALKEGMGGGGGGHDPFDIFQSFFGGNPFGGGGGSSRGRRQRRGEDVIHPLKVSLEDLYNGTSKKLSLSRNVICSKCKGKGSKSVLHEMCRXSRFGNESFHQTSWPIYDPANAASL

SEQ ID NO: 14344 - protein, 418 aa, Sorghum bicolor
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSRNVLCSKCNGKGSKSGASSRCAGCQGSGFKVQIRQLGPGMIQQMQHPCNECKGSGETINDKDRCPQCKGDKVVQEKKVLEVVVEKGMQNGQKITFPGEADEAPDTVTGDIIFVLQQKEHPKFKRKGDDLFYEHTLTLTESLCGFQFVLTHLDNRQLLIKSNPGEVVKPDSFKAINDEGMPMYQRPFMKGKLYIHFSVDFPDSLSLEQCKALEAVLPPKPVSQYTDMELDECEETMPYDVNIEEEMRRRQQQHQEAYDEDEDMPGGAQRVQCAQQ

SEQ ID NO: 14345 - protein, 418 aa, Nicotiana tabacum
MFGRTPKKSDNTKYYEILGVPKSASQDDLKKAYRKAAIKNHPDKGGDPEKFKELAQAYEVLSDPEKREIYDQYGEDALKEGMGGGGGGHDPFDIFQSFFGGGSPFGGGGSSRGRRQRKGEDVVHPLKVSLEDVYNGTSKKLSLSRNVLCTKCKGKGSKSGVSMKCSGCQGSGMKVSIRQLGPSMIQQMQHPCNECKGTGETINDKDRCPQCKGEKVVQEKKVLEVHVEKGMQNGQKITFPGEADEAPETITGDIVFILQQKEHPKFKRKGDDLFVEHTLTLTEALCGFQFILTHLDNRQLLIKSQPGEVVKPDQFKAINDEGMPMYQRPFMRGKLYIHFTVDFPESLTPEQCKNLEAVLPPKPKMEVSEMELDECEETTLHDVNIEEEMRRKQQAAQEAYDEDDDMPGGAQRVQCAQQ

SEQ ID NO: 14346 - protein, 414 aa, Theobroma cacao
MFGRAPKKSDNTRYYEILGVSKNASQDDLKKAYKKTAFKNHPDKGGDPEKFKELAQAYEVLSDPEKREIYDQYGEDALKDGMGATGAHDPFDIFSSFFGGSPFGGGSSRGRRQRRGEDVIHNMKVSLEDLYLGTSKKLSLSRNILCSKCNGKGSKSGASMQCPGCQGSGMKVSIRHLGPSMIQQMQHPCNECKGTGETINDKDRCPQCNGEKVVQEKKVLEVIVEKGMQHGQKITFPGEADEVPDTITGDIVFVLQQKEHPKFKRKGEDLFVEHTLSLTEALCGFQFVLTHLDGRQLLIKSNSGEIVKPDSFKAINDEGMPLYQRPFMKGKLYIHFTVDFPDSLSPDQVQALEAILPPKPTSQLTDMELDECEETTLHDVNIEEEMRRKQQAAQETLDEEEMHGGAQRVQCAQQ

SEQ ID NO: 14347 - protein, 418 aa, Ricinus communis
MFGRAPKKSDNTKYYEILGVSKNATQDDLKKAYKRAAIKNHPDKGGDPEKFKELAQAYEVLSDPEKREIYDQYGEDALKEGMGGGGAGHNPFDIFESFFGGSPFGGGSSRGGRRQRRGEDVVHPLKVSLEDLYLGTIKKLSLSRNMICAKCNGKGSKSGASMKCSGCQGTGMKVSIRQLGPSMIQQMQHACNECKGTGESISEKDRCTQCKGEKVVPEKKVLEVIVEKGMQHGQKITFPGEADEAPDTITGDIVFVLQQKDHPKFKRKEDDLVVDHNLSLTEALCGFQFVLTHLDGRQLLIKSTPGEVVKPGSFKAINDEGMPMYQRPFMKGKLYIHFNVDFPDSLTADQVKALEAILPLRSSTQLTDMELDECEETTLHDVNMEEEMRRKQQQAQQEAYDEDDDMPSGAQRVQCAQQ

SEQ ID NO: 14348 - protein, 419 aa, Panicum virgatum
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRSVICSKCKGKGSKSGASMRCPGCQGSGMKITIRQLGPSMIQQMQTACNECKGTGESINEKDRCPGCKGEKVVQKKKVLEVHVEKGMQHNQKITFPGEADEAPDTVTGDIVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEAVLPPKLTPKLTDMEIDECEETTMHDVNNIEEEMRRKQAHAAQEAYEEDDEMPGGAQRVQCAQQ

SEQ ID NO: 14349 - protein, 421 aa, Valeriana officinalis
MFGRAPKKSDNTKYYEILGVNKNASQDDLKKAYRKAAIKNHPDKGGDPEKFKELAQAYEVLSDPEKREVYDQYGEDALKEGMGSGGGGHDPFDIFQSFFGGSPFGGGGGSSRGRRQRRGEDVVHPLKVSLEDLYNGTSKKLSLSRNVLCSKCKGKGSKSGASMKCAGCQGSGMKVSIRHLGPSMIQQMQHPCNECKGTGEAISDKDRCPQCKGEKVVQEKKVLEVVVEKGMQNGQKITFPGEADEAPDTVTGDIVFVVQQKEHPKFKRKGDDLFLEHTLSLTEALCGFQFILSHLDNRQLLIKSEPGEVIKPDQFKGINDEGMPMHQRPFMRGKLYIHFTVEFPDSLSSEQCKGLESVLPARPSKVITDMELDECEETTLHDVNIEEEMRRKQHQAAQEAYDEDDDDMHGGGAQRVQCAQQ

SEQ ID NO: 14350 - protein, 330 aa, Carthamus tinctorius
  misc_feature (268)..(268): Xaa can be any naturally occurring amino acid
  misc_feature (273)..(273): Xaa can be any naturally occurring amino acid
  misc_feature (311)..(311): Xaa can be any naturally occurring amino acid
  misc_feature (327)..(328): Xaa can be any naturally occurring amino acid
MFGRAPKKSDNTKYYEILGVPKNASQDDLKKAYRKAAIKNHPDKGGDPEKFKELAQAYEVLSDTEKREIYDQYGEDALKEGMGGGGGGHDPFDIFQSFFGGNPFGGGGGSSRGRRQRRGEDVIHPLKVSLEDLYNGTSKKLSLSRNVICSKCKGKGSKSGASMKCAGCQGSGMKVSIRHLGPSMIQQMQHPCNECKGTGETINDKDRCPQCKGEKVVQEKKVLEVHVEKGMQNGQKITFPGEADEAPDTVTGDIVFVLQQKEHPKFKXKGDDXFVEHTLSLTEALCGFQFILTHLDSRQLLIKSQPGEVVXPDQFKAINDEECPCIXXHL

SEQ ID NO: 14351 - protein, 418 aa, Manihot esculenta
MFGRAPKKSDNTRYYEILGVSKNASQDDLKKAYKKAAIKNHPDKGGDPEKFKELAQAYEVLSDPEKREIYDNYGEDALKEGMGGGGGGHNPFDIFESFFGGNPFGGGSSRGRRQRRGDDVVHPLKVSLEDLYLGTTKKLSLSRNVICSKCNGKGSKSGASMKCPGCRGTGMKVSIRQLGPSMIQQMQHPCNECKGTGESISEKDKCTQCKGEKVVPGKKVLEVIVEKGMQHGQKITFPGEADEAPDTITGDIVFVLQQKEHPKFKRKGDDLIVEQSLSLTEALCGFQFVLTHLDGRHLLIKSNTGEVVKPDSFKAINDEGMPMYQRPFMKGKLYIHFIVEFPDSLTPDQVKALEAILPPRPFSQLMDIDLDECEETTLHDVNMEEEMRRKQQGQAQREAYDEDEEMHGGAQRVQCAQQ

SEQ ID NO: 14352 - protein, 417 aa, Curcuma longa
MFGRAPKKSDNTRYYEVLGVPKSASQDDLKKAYRKAAIKNHPDKGGDPEKFKELAQAYEVLSDPEKREIYDQYGEDALKEGMSGGGGGHDPFDIFQSFFGGSPFGGGSSRGRRQRRGEDVVHPLKVSLEDLYNGTSKKLSLSRNVICRKCNGKGSKSGASMTCPGCHGSGMKVSIRQLGPGMIQQMQHPCSECKGTGERINEKDRCSDCKGEKVVPEKKVLEVVVEKGMQNGQKISFHGEADEAPDTLTGDIVFVLQQKEHPKFMRKGEDLFYEHSLSLTEALCGFQFVLNHLDGRQLLIKSNPGEVVKPDQNKAINDEGMPIHQRPFMKGKLYIHFTVDFPDSLAPAQSKALEAVLPPKPASQLMDMELDECEETILHDVNMKEEMRRKQAQAQEAYEEDEDDLHGGGQRVQCAQQ

SEQ ID NO: 14353 - protein, 418 aa, Setaria italica
MFGRAPKKSDNTRYYEILGVPKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRKGEDVVHPLKVSLDELYNGTSKKLSLSRNVLCSKCNGKGSKSGASSRCAGCQGSGYKVQIRQLGPGMIQQMQHPCNECKGTGETINDKDRCPQCKGEKVVQEKKVLEVVVEKGMQNGQKITFPGEADEAPDTVTGDIIFVLQQKEHPKFKRKGDDLFYEHTLTLTESLCGFQFVLTHLDNRQLLIKSNPGEVVKPDSFKAINDEGMPMYQRPFMKGKLYIHFSVEFPDSLNPEQCKALEAVLPPKPTSQYTDMELDECEETMPYDVNIEEELRRRQQQHQEAYDEDEDMPGGAQRVQCAQQ

SEQ ID NO: 14354 - protein, 417 aa, Zea mays
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGSSRGRRQRRGDDVVHPLKVSLEDLYNGTSKKLSLSRNVLCSKCNGKGSKSGASSRCAGCQGSGFKVQIRQLGPGMIQQMQHPCNECKGSGETISDKDRCPQCKGDKVVPEKKVLEVVVEKGMQNGQKITFPGEADEAPDTATGDIIFVLQQKEHPKFKRKGDDLFYEHTLILTESLCGFQFVLTHLDNRQLLIKSNPGEVVKPDSFKAINDEGMPMYQRPFMKGKLYIHFSVEFPDSLSPEQCKALEAVLPPKPVSQYTDMELDECEETMTYDVNIEEEMRRRQQQHQEAYDEDDDVPGGGQRVQCAQQ

SEQ ID NO: 14355 - protein, 418 aa, Zea mays
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSRSVLCSKCNGKGSKSGASSRCAGCQGSGFKVQIRQLGPGMIQQMQHPCNECKGSGETISDKDRCPQCKGDKVVQEKKVLEVFVEKGMQNGQKITFPGEADEAPDTVTGDIIFVLQQKEHPKFKRKGDDLFYEHTLTLTESLCGFQFVVTHLDNRQLLIKSNPGEVVKPDSFKAINDEGMPMYQRPFMKGKLYIHFSVEFPDSLSPEQCKALEAVLPPKPVSQYTDMELDECEETMPYDVNIEAEMRRRQQQHQEAYDEDEDMPGGAQRVQCAQQ

SEQ ID NO: 14356 - protein, 413 aa, Momordica charantia
MFGRPKKSDNTKYYEILGVSKNASQDDLKKAYRKAAIKNHPDKGGDPEKFKELAQAYEVLSDPEKREIYDQYGEDALKEGMGGGGGHDPFDIFQSFFGGSPFGGGGSSRGRRQRRGEDVIHPLKVSLEDLYNGTSKKLSLSRNVICSKCKGKGSKSGASMKCPGCQGSGMKVSIRHLGPSMIQQMQHPCNDCKGTGETINDKDRCSQCKGEKVVQEKKVLEVIVEKGMQNGQKITFPGEADEVPDTLTGDIVFVLQQKENAKFKRKGDDLFVEHTLSLVESLCGFQFILTHLDSRQLLIKSLPGEVVKPDQFKAINDEGMPMYQRPFMKGKLYIHFSVDFPDSLNPDQCKALEGVLPPRTSVQLSDMELDECEETTIHDVNIEEEMRRKQVQEAYDEDDDMHGGAQRVQCAQQ

SEQ ID NO: 14357 - protein, 418 aa, Solanum lycopersicum
MFGRAPKKSDNTKYYEILGVPNTASPDDLKKAYRKAAIKNHPDKGGDPEKFKEIAQAYEVLNDPEKREIYDQYGEDALKEGMGGGGGGHDPFDIFQSFFGGGGFGGGGSSRGRRQRRGEDVVHPLKVSLEDLYNGISKKLSLSRNVLCSKCKGVGSKSGASLKCPGCQGKGMKVSIRQLGPMIQQMQHPCNECRGTGEKINDKDRCPQCKGEKVVQEKKVLEVVVDKGMQNGQKITFPGEADEEPDTVTGDIVFILQQKEHPKFKRKGDDLFVEHTLTLTEALCGFQFVLTHLDNRQLIIKSQPGEVVKPDQFKAINDEGMPMYQRPFMKGKLYIHFTVDFPNTLTPELCKNLEAVLPARPKTQASDMELDECEETTLHDVNIDEEMRRKQQQQAQEAYDEDDDDMHGGAQRVQCAQQ

SEQ ID NO: 14358 - protein, 354 aa, Hevea brasiliensis
MFGRAPKKSDNTKYYEILGVSKNASQDDLKKAYRKAAIKNHPDKGGDPEKFKELAQAYEVLSDPEKREIYDQYGEDALKEGMGSGGGAHDPFDIFQSFFGGNPFGGGGSSRGRRQRRGEDVIHPLKVSLEDLYNGTSKKLSLSRNVICSKCKGKGSKSGASMKCSGCQGSGMKVSIRQLGPSMIQQMQHPCNECKGTGETINDKDRCPQCKGEKVVQEKKVLEVIVEKGMQNGQRITFPGEADEAPDTITGDIVFVLQQKEHPKFKRKGDDLIVDHTLSLTEALCGFQFILTHLDGRQLLIKSQPGEVVKPDQFKAINDEGMPMYQRPFMRGKLYLFISVLISQTLCPLISAKP

SEQ ID NO: 14359 - protein, 421 aa, Avena sativa
MFGRAPKKSDNTKYYEILGVPKTAAPDELKKAYRKAAIKNHPDKGGDPEKFKELAQAYEVLSDPEKREIYDQYGEDALKEGMGGGGGGVDPFDIFSSFFGPSFGGGGGGSSRGRRQRRGEDVVHPLKASLEDLYNGTSKKLSLSRSVLCSKCKGKGSKSGASMRCPGCQGSGMKVTIRQLGPSMIQQMQQPCNECRGTGESINDKDRCPGCKGEKVLQEKKVLEVHVEKGMQHNQKITFPGEADEAPDTVTGDIVFVVQQKEHPKFKRKGDDLFYEHTISLTEALCGFQLVLTHLDNRQLLIKSNPGEVVKPDSFKAISDEGMPMYQRPFMKGKLYIHFTVDFPDSLAPDQCKALEAVLPPKPASKLTDMELDECEETTMHDVNNIEEEMRRKAAHAAQEAYDEDDEMPGGGGQRVQCAQQ

SEQ ID NO: 14360 - protein, 419 aa, Panicum virgatum
MFGRAPKKSDNTKYYEILGVPKSASQDDLKKAYRKAAIKNHPDKGGDPEKFKELAQAYEVLSDPEKREIYDQYGEDALKEGMGGGGAHVDPFDIFSSFFGPSFGGGGGSSRGRRQRRGEDVVHPLKVSLEDLYNGTSKKLSLSRSVICSKCKGKGSKSGASMRCPGCQGSGMKVTIRQLGPSMIQQMQTACNECKGTGESINEKDRCPGCKGEKVVQEKKVLEVHVEKGMQHNQKITFPGEADEAPDTVTGDIVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEALLPPKPTSKLTDMEIDECEETTMHDVNNIEEEMRRRQAHSAQEAYEEDDEMPGGAQRVQCAQQ

SEQ ID NO: 14361 - protein, 422 aa, Valeriana officinalis
MFGRAPKKSDNTKYYEILGVSKNASQDDLKKAYRKAAIKNHPDKGGDPEKFKELAQAYEVLSDPEKREVYDTYGEDALKEGMGGGGGGHDPFDIFQSFFGGGNPFGGGSGGGSSRGRRQRRGEDVVHPLKVSLEDLYNGTSKKLSLSRNVLCSKCKGKGSKSGASMKCAGCQGSGMKVSIRHLGPSMIQQMQHPCNDCKGTGETINDKDRCPQCKGEKVVQEKKVLEVHVEKGMQNGQKITFPGEADEAPDTVTGDIVFVLQQKEHPKFKRKGEDLFVEYTLTLTEALCGFQFILTHLDNRQLLIKSQPGEVIKPDQFKAINDEGMPLYNRPFMRGKLYIHFSVDFPDSLTPEQCKALEAVLPAKPSTQMTDMELDECEETTLHDVNIEEEMRRKQQAAQEAYDEDDDMHGAGGQRVQCAQQ

SEQ ID NO: 14362 - protein, 428 aa, Cichorium intybus
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGGNPFGGGGGSSRGRRQRRGEDVIHPLKVSLEDLYNGTSKKLSLSRNVLCSKCKGKGSKSGASMKCAGCQGSGMKVSIRHLGPSMIQQMQHPCNECKGTGETINDKDRCPQCKGEKVVQEKKVLEVHVEKGMQNSQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMKGKLYIHFTVEFPESLSPEQCKALEGVLPARPAMQMTDMELDECEETTLHDVNIEEEMRRKQQQQAQEAYDEDDDMPGGAQRVQCAHNEVDVWLYL

SEQ ID NO: 14363 - protein, 418 aa, Euonymus alatus
MFGRQPKKSDNTKYYEVLGVSKNASPDDLKKAYRKAAIKNHPDKGGDPEKFKELAQAYEVLSDPEKRDIYDQYGEDALKEGMGGGGGGHDPFDIFSSFFGGSPFGGGGSSRGRRQRRGEDVTHPLKVSLEDLYNGTSKKLSLSRNVICSKCKGKGSKSGASMKCSGCHGSGMKVSIRQLGPSMIQQMQHPCNECKGTGEMINDKDRCPQCKGEKVMQEKKVLEVVVEKGMQNGQKITFPGEADEAPDTVTGDIVFVLQQKVHPKFKRKGDDLFVEHTLSLTEALCGFQFIITHLDGRQLIIKTQPGEVVKPDQFKAINDEGMPMYQRPFMKGKLYIHFTVEFPDTLTVEQCKALETVLPPRTSTQLTDMELEECEETTLHHVNIEEEMRRKEQQRAQEAYDEDEEMPGGAQRVQCAQQ

SEQ ID NO: 14364 - protein, 418 aa, Euonymus alatus
MFGRAPKKSDNTKYYEILGVSKNASQDDLKKAYRKAAIKNHPDKGGDPEKFKELAQAYEVLSDPEKRDIYDQYGEDALKEGMGGGGGAHDPFDIFSSFFGGSPFGGGGSSRGRRQRRGEDVIHPLKVSLEDLYNGTSKKLSLSRNVICSKCKGKGSKSGASMKCSGCQGSGMKVSIRHLGPSMIQQMQHACNECKGTGEMINDKDRCPQCKGEKVMQEKKVLEVVVEKGMQNGQKITFPGEADEAPDTVTGDIVFVLQQKEHPKFKRKGDDLFVEHTLSLTEALCGFHFIITHLDGRQLIIKSQSGEVVKPDQFKAINDEGMPMYQRPFMKGKLYIHFTVDFPDTLAPEQCKALEAVLPPRTSTLLTDMELEECEETTMQDVNIEEEMRRKEQQRAQEAYDEDEDMHGGAQKVQCAQQ

SEQ ID NO: 14365 - protein, 418 aa, Euonymus alatus
MFGRQPKKSDNTKYYEVLGVSKNASPDDLKKAYRKAAIKNHPDKGGDPEKFKELAQAYEVLSDPEKRDIYDQYGEDALKEGMGGGGGGHDPFDIFSSFFGGSPFGGGGSSRGRRQRRGEDVTHPLKVSLEDLYNGTSKKLSLSRNIICSKCKGKGSKSGASMKCSGCHGSGMKVSIRQLGPSMIQQMQHPCNECKGTGEMINDKDRCPQCKGEKVMQEKKVLEVVVEKGMQNGQKITFPGEADEAPDTVTGDIVFVLQQKVHPKFKRKGDDLFVEHTLSLTEALCGFQFIITHLDGRQLIIKTQPGEVVKPDQFKAINDEGMPMYQRPFMKGKLYIHFTVEFPDTLTVEQCKALETVLPPRTSTQLTDMELEECEETTLHHVNIEEEMRRKEQQRAQEAYDEDEEMPGGAQRVQCAQQ

SEQ ID NO: 14366 - protein, 418 aa, Actinidia deliciosa
MFRRGAKKSDNTKYYDVLGVSKDATQEDLKKAYRKAAIKNHPDKGGDPEKFKELAQAYEVLSDPEKREIYDQYGEDALKEGMGGGGGMHDPFDIFQSFFGGGNPFGGGGSSRGRRQRRGEDVVHPLKVSLEDLYIGISKKLSLSRNVICSKCNGKGSKSGNSMKCTGCQGSGMKVTIRQLGPGMIQQMQHPCNECKGTGESINEKDRCPLCKGEKVVQEKKVLEVIVEKGMQNGQKITFPGEADEAPDTITGDIVFVLQQKEHPKFKRKGDDLFMEHTLSLVEALCGFRFILTHLDGRQLLIKSDPGEVVKPDQFKAINDEGMPVYQRAFMKGKLYIHFTVDFPDSLDPDQIKALQAVLPPRPSMQLSDMELDECEETTLHDVNMEEEMRRKQAQAQEAYDEDEDMRGGGQRVQCAQQ

SEQ ID NO: 14367 - protein, 418 aa, Panicum virgatum
MFGRAPKKSDNTRYYEILGVPKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEELYNGTSKKLSLSRNVLCSKCNGKGSKSGASSRCAGCQGSGYKVQIRQLGPGMIQQMQHPCNECKGTGETISDKDRCPQCKGEKVVQEKKVLEVVVEKGMQNGQKITFPGEADEAPDTVTGDIIFVLQQKEHPKFKRKGDDLFYEHTLTLTESLCGFQFVLTHLDNRQLLIKSKPGEVVKPDSFKAINDEGMPMYQRPFMKGKLYIHFSVEFPDSLNPEQCKALEAVLPAKPASQYTDMELDECEETMPYDVNIEEELRRRQQQHQEAYDEDEDMPGGAQRVQCAQQ

SEQ ID NO: 14368 - protein, 418 aa, Panicum virgatum
MFGRAPKKSDNTRYYEILGVPKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEELYNGTSKKLSLSRNVLCSKCNGKGSKSGASSRCAGCQGSGYKVQIRQLGPGMIQQMQHPCNECKGTGETISDKDRCPQCKGEKVVQEKKVLEVVVEKGMQNGQKVTFPGEADEAPDTVTGDIIFVLQQKEHPKFKRKGDDLFYEHTLTLTESLCGFQFVLTHLDNRQLLIKSNPGEVVKPDSFKAINDEGMPMYQRPFMKGKLYIHFSVEFPDSLNPEQCKALEAVLPPKPASQYTDMELDECEETMPYDVNIEEELRRRQQQHQEAYDEDDEMPGGAQRVQCAQQ

SEQ ID NO: 14369 - protein, 419 aa, Vinca minor
MFGRAPKKSDNSKYYEVLGVSKNASQDDLKKAYRKAAIKNHPDKGGDPEKFKELAQAYEVLSDPEKREIYDQYGEDALKEGMGSGGGGHDPFDIFSSFFGGGSPFGGGGSSRGRRQRRGEDVIHPLKVSLEDLYNGTSKKLSLSRNVLCQKCKGKGSKSGASMTCSGCQGSGMKVSIRHLGPSMIQQMQHPCNECKGTGETINDKDRCPQCKGEKVVQEKKVLDVIVEKGMQNGQKITFPGEADEAPDTVTGDIVFVLQQKVHPKFKRKGDDLFVEHTLSLTEALCGFQFILTHLDNRQLLIKSQPGEVIKPDQFKAINDEGMVIYQRPFMRGKLYIHFNVEFPDSLNPEQCKALEAVLPPRPTTQITEMELDECEETTLHDVNIEEEMRRKSQQSAQEAYDEDEDMHGGAQRVQCAQQ

SEQ ID NO: 14370 - protein, 419 aa, Vinca minor
MFGRGPKKSDNSKYYEVLGVPKDASQDDLKKAYRKAAIKNHPDKGGDPEKFKELAQAYEVLSDPEKREIYDQYGEDALKEGMGSGGGGHDPFDIFSSFFGGGSPFGGGGSSRGRRQRRGEDVIHPLKVSLEDLYNGTSKKLSLSRNVLCQKCKGKGSKSGASMKCSGCQGSGMKVSIRHLGPSMIQQMQHPCNECKGTGETINDKDRCPQCKGEKVAQQKKVLEVIVEKGMQNGQKITFPGEADEAPDTVTGDIVFVLQQKVHPKFKRKGDDLFVEHTLSLTEALCGFQFILTHLDNRQLLIKSQPGEVIKPDQFKVINDEGMVMYQRPFMRGKLYIHFNVEFPESLSLEQCKALEAVLPPRPTKQITEMELDECEETTLHDVNIEEEMRRKTQQAAQEAYDEDEDMHGGAQRVQCAQQ

SEQ ID NO: 14371 - protein, 423 aa, Fragaria vesca
MFGGGRAPKKSDNSKYYEILGVSKTASPEDVKKAYKKAAIKNHPDKGGDPEKFKELAQAYEVLSDPEKREIYDRYGEDGLKEEMQSGGHDPFDIFSSFFGGGGSPFGGMPGGSSRGRRQRRGEDVVHPLKVSLEDLYLGTSKKLSLSRNVLCSKCKGKGSKSGASTKCGGCQGTGMKVTIRHLGPSMIQQMQHACNECKGTGETISDKDRCGQCKGEKVVHEKKVLEVHVEKGMQNGQKITFPGEADEAPDTVTGDIVFIIQQKEHPKFKRKMDDLFVEHSLSLTDALCGFQFVLNHLDGRQLLIKSNPGEVVKPDSFKAVNDEGMPMYQRPFMKGKLYIHFSVDFPETLSPEQVKALEAALPSRASSQQLTDMELDECEETTLHDVNMEEEMRRKQHQAHSEAYDEDDDMPGGAQRVQCAQQ

SEQ ID NO: 14372 - protein, 417 aa, Amsonia hubrichtii
MFGRAPKKSDNTKYYEILGVSKNASQDDLKKAYRKAAIKNHPDKGGDPEKFKELAQAYEVLSDPEKREIYDQYGEDALKEGMGGGGGVHDPFDIFQSFFGGSPFGGGGSSRGRRQRRGEDVIHPLKVSLEDLYNGTSKKLSLSRNVLCQKCKGKGSKSGASMRCSGCQGSGMKVSIRHLGPSMIQQMQHPCNECKGTGETINDKDRCPTCKGEKVVQEKKVLEVIVEKGMQNGQKITFPGEADEAPDTVTGDIVFILQQKEHPKFKRKGDDLFVEHTLSLTEALCGFQFILTHLDNRQLLIKSQPGEVIKPDQFKAINDEGMVIYQRPFMRGKLYIHFHVEFPESLTPEQCKALETVLPPRPTKQITEMELDECEETTLHDVNIEEEMRRKNQQAQEAYDEDEDMHGGAQRVQCAQQ

SEQ ID NO: 14373 - protein, 417 aa, Euphorbia peplus
MFGRAPKKSDNTKYYEILGVSKNAGPDDVKKAYRKAAIKNHPDKGGDPEKFKEISQAYEVLSDPEKRELYDQYGEDALKEGMGGGGGGHDPFDIFQSFFGGSPFGGGGSSRGRRQRRGEDVTHPLKVSLEDLYNGTSKKLSLSRNVICVKCKGKGSKSGASMKCSGCQGSGMKVSIRHLGPSMIQQMQHPCNECKGTGETINDKDRCPQCKGEKVSQEKKVLEVHVEKGMQNGQKITFPGEADEAPDTVTGDIVFILQQREHPKFKRRGDDLVVEHTLSLTEALCGFQFILSHLDGRQLLIKSQPGEVVKPDQFKAINDEGMPMYQRPFMRGKLYIHFNVEFPDSLPVDQSKALEAVLPSRTSVQLSDMEVDECEETTLHDVNFEEEMRRKQQQSAEAYDEDDDMPGGAQRVQCAQQ

SEQ ID NO: 14374 - protein, 420 aa, Nicotiana tabacum
MFGRATKKSDNTKYYEILGVPKTASPEDLKKAYRKAAIKNHPDKGGDPEKFKELAQAYEVLSDPEKREIYDQYGEDALKEGMGGGGGGHDPFDIFSSFFGGSPFGGGMGGGSSRGRRQKRGEDVVHPLKVSLDDLYNGTSKKLSLSRNVLCPKCKGKGSKSGVSMKCSGCQGSGMKVTIRHLGPSMIQQMQHACNECKGSGETISDKDRCGQCKGEKVVQEKKVLEVVVEKGMQNGQKITFPGEADEAPDTITGDIVFILQQKEHPKFKRKGDDLFVEHTLSLTEALCGFQFILTHLDNRQLLIKSQPGEVVKPDQFKAINDEGMPMYQRPFMRGKLYIHFTVDFPETLSLEQCKNLEAVLPPKPKTQMTDMELDECEETTLHDVNIEEEMRRKQQQAQEAYNEDEDMHGGAQRVQCAQQ

SEQ ID NO: 14375 - protein, 417 aa, Zingiber officinale
MFGRAPKKSDNTRYYETLGVPKTASQDDLKKAYRKAAIKNHPDKGGDPEKFKELAQAYEVLSDPEKREIYDQYGEDALKEGMSGGGGGHDPFDIFQSFFGGSPFGGGSSRGRRQRRGEDVIHPLKVSLEDLYNGTSKKLSLSRNVICRKCNGKGSKSGASMTCSGCRGSGMKVSIRQLGPGMIQQMQHPCSECKGTGERINEKDRCSDCKGEKVVPEKKVLEVVVEKGMQNGQKISFHGEADEAPDTLTGDIVFVLQQKEHPKFMRKGEDLFYEHSLSLTEALCGFQFVLNHLDGRQLLIKSNPGEVVKPDQNKAINDEGMPIHQRPFMKGKLYIHFTVDFPDSLAPAQSKALEAVLPPKPASQLMDMELDECEETILHDVNMKEEMRRKQAQAQEAYEEDEDDLHGGGQRVQCAQQ

SEQ ID NO: 14376 - protein, 417 aa, Oryza sativa
MFGRAPKKSDNTRYYEVLGVPKDASQDDLKKAYRKAAIKNHPDKGGDPEKFKELAQAYEVLSDPEKREIYDQYGEDALKEGMGPGGGMHDPFDIFSSFFGGGFGGGSSRGRRQRRGEDVVHPLKVSLEELYNGTSKKLSLSRNVLCSKCNGKGSKSGASMKCSGCQGSGMKVQIRQLGPGMIQQMQHPCNECKGTGETISDKDRCPGCKGEKVAQEKKVLEVVVEKGMQNGQKITFPGEADEAPDTVTGDIIFVLQQKEHPKFKRKGDDLFYEHTLNLTEALCGFQFVLTHLDNRQLLIKSKPGEVVKPDSFKAVNDEGMPMYQRPFMKGKLYIHFSVEFPDSLNPDQCKALETVLPPRPVSQYTDMELDECEETMPYDVNIEEEMRRRQQQQQQEAYDEDEDMHGGGAQRVQCAQQ

SEQ ID NO: 14377 - protein, 416 aa, Plantago ovata
MFGRAPKKSDNTKYYDILGVPKTASPDDLKKAYKKAAIKNHPDKGGDPEKFKELAHAYEVLSDPEKREIYDQYGEDALKEGMPNGGMHDPFDIFSSFFGGGSPFGGGGSSRGRRQRRGEDVVHPLKVSLEDLYLGTTKKLSLSRNVICSKCSGKGSKSGASMKCSGCQGSGMKVTIRQLGPGMIQQMQHPCNECKGTGETISDKDRCSQCKGEKVVQQKKVLEVHVEKGMQNGQKITFPGEADEAPDTVTGDIVFVLQQKEHPRFKRKGEDLFVEHSLSLTEALCGFQFILTHLDGRQLLIKSQLGEVVKPNSFKAINDEGMPMYGRPFMKGRMYIHFSVEFPDSLAPEQVEALAKILPPKPGTQITDMELDECEETTLYDVNNIEEEMRRKAQQEAYEEEDEDMQGGQRVQCAQQ

SEQ ID NO: 14378 - protein, 417 aa, Amorphophallus konjac
MFGRAPKKSDNTRYYEILGVSKNGSQEDLKRAYRKAAIKNHPDKGGDPEKFKELAQAYEVLSDPEKREIYDQYGEDALKEGMGGGGAHVDPFDIFSSFFGGNPFGGGGSSRGRRQKRGEDVIHPLKVSLEDLYSGTSKKLSLSRNIICSKCKGKGSKSGASMRCAGCQGSGMKVSIRQLGPGMIQQLQHPCNECKGTGEAINEKDRCPQCKGEKVVPEKKVLEVHVEKGMQNGQRITFPGEADEAPDTVTGDIVFVLQQKEHPKFKRKGDDLFVEHTLSLTEALCGFQYVLTHLDGRQLLIKTNPGEVVKPDQFKAINDEGMPMYQRPFMRGKLYIHFTVEFPDSLTLEQCKALDAVLPSRPSAQLTDMELDDCEETTMHDVNIEEEMRRKQQAAQEAYDEDEEMHGGAQRVQCAQQ

SEQ ID NO: 14379 - protein, 421 aa, Centaurea maculosa
  misc_feature (12)..(12): Xaa can be any naturally occurring amino acid
  misc_feature (357)..(357): Xaa can be any naturally occurring amino acid
  misc_feature (365)..(365): Xaa can be any naturally occurring amino acid
  misc_feature (368)..(368): Xaa can be any naturally occurring amino acid
MFGRAPKKSDNXKYYEILGVPSTASQDDLKKAYRKAAIKNHPDKGGDPEKFKELAQAYEVLSDPEKRQIYDEYGEDALKEGMGGGGGGHDPFDIFQSFFGGTPFGGGGSSSRGRRQRRGEDVIHPLKVSLEDLYNGTSKKLSLSRNVICSKCTGKGSKSGASMKCSGCQGSGMKVSIRHLGPSMIQQMQQPCNECKGTGETIDDKDRCPQCKGEKVVPEKKVLEVHVEKGMQNGQKITFPGEADEAPDTVTGDIVFVLQQKEHPKFKRKGDDIFYEHTLNLTEALCGFQFILTHLDNRQLLIKSLPGEVVKPDQFKAINDEGMPMYQRPFMKGKLYIHFSVDFPDSISPDQCKVLEXVLPARPSXQIXDMELDECEETTLHDVNIEEEMRRKQQQAAQEAYDEDDDDDMHGGAQKVQCAQQ

SEQ ID NO: 14380 - protein, 418 aa, Ipomoea batatas
MFARAPKKSDNTKYYEILGVSKNASQDDLKKAYRKSAIKNHPDKGGDPEKFKELAQAYEVLSDPEKREIYDQYGEDALKEGMGGGGGMHDPFDIFQSFFGGNPFGGGGSSRGRMQRRGEDVVHPLKVSLEDLYNGTSKKLSLSRNVLCPKCKGKGSKSGASMKCSGCQGSGMKVSIRQLGPSMIQQMQHPCGECKGTGETINEKDRCGQCKGEKVVQEKKVLEVLVEKGMQNGQKITFPGEADEAPDTVTGDIVFVLQQREHAKFKRKGDDLFLEHTLTLTEALCGFQFILTHLDNRQLLIKSQPGEVVKPDQFKAINDEGMPMYQRPFMRGKLYIHFTVDFPESLSPDQCKALETVLPPRPTTGITEMELDECEETTLHDVNIEEEMRRKQQQQAQEAYEEDDDMHGGAQRVQCAQQ

SEQ ID NO: 14381 - protein, 412 aa, Actinidia deliciosa
MFGRAPKKSDNTKYYEILGVSKSASQDDLKKAYRKAAIKNHPDKGGDPEKFKELAQAYEVLSDPEKRDIYDQYGEDALKEGMGGGGGGHDPFDIFQSFFGGGGSSRGRRQRRGEDVIHPLKVSLEDLYNGTSKKLSLSRNVICSKCKGKGSKSGASMKCGGCQGSGMKVSIRHLGPSMIQQMQHPCNECKGTGETINDKDRCLQCKGDKVVGEKKVLEVIVEKGMQNGQKITFPGEADEAPDTVTGDIVFVLQQKEHLKFKRKGDDLFVEHTLALTEALCGFQFILTHLDNRQLLIKSQPGEVIKPDQFKAINDEGMPMYQRPFMRGKLYIHFTVDFPESLNEDQCKALEAVLPPRPSLQMSEMELDECEETTLHDVNIEEEMRRKQQQSQEAYDEDEEMHGGAQRVQCAQQ

SEQ ID NO: 14382 - protein, 417 aa, Actinidia deliciosa
MFGRAPKKSDNTKYYGILGVSKNASQDDLKKAYRKAAIKNHPDKGGDPEKFKELAQAYEVLSDPEKREIYDQYGEDALKEGMGGGGGGHDPFDIFQSFFGGNPFGGGGSSRGRRQRRGEDVMHPLKVSLEDLYNGTSKKLSLSRNVICSKCKGKGSKSGASMKCAGCQGSGMKVSIRHLGPSMIQQMQHPCNECKGTGESINDKDRCPQCKGDKVVGEKKVLEVIVEKGMQNGQRITFPGEADEAPDTVTGDIVFVLQQKEHLKFKRKGDDLFVEHTLTLTEALCGFQFILTHLDNRQLLIKSQPGEVIKPDQFKAINDEGMPMYQRPFMRGKLYIHFTVDFPESLTVEQCKALEAVLPPRPSLQMSEMELDECEETTLHDVNIEEEMRRKQQQAQEAYDEDEEMPGGAQRVQCAQQ

SEQ ID NO: 14383 - protein, 418 aa, Actinidia deliciosa
  misc_feature (415)..(415): Xaa can be any naturally occurring amino acid
MFGRPPKKSNNTKYYEVLGVSKSASQDDLKKAYRKAAIKNHPDKGGDPEKFKELAQAYEVLSDPEKREIYDQYGEDALKEGMGGGGGGHDPFDIFQSFFGGSPFGGGGSSRGRRQRKGEDVIHPLKVSLEDLYNGTAKKLSLSRNVICFKCKGKGSKSGASMTCTSCQGSGMKVSIRHLGPSMIQQMQHPCNECKGTGETISDKDRCPQCKGEKVVGEKKVLEVVVEKGMQNGQRITFPGEADEAPDTVTGDIVFVLQQKEHPKFKRKGDDLFVEHTLTLTEALCGFQFILTHLDNRQLLIKSQPGEVIKPDSFKGINDEGMPMYQRPFMKGKMYIHFTVDFPESLTPEQSKALEAVLPLKPSIQMSEMELDECEETTLHDVNIEEEMRRKQQQQAQEAYDEDEDMHGGAQRVQXAQQ

SEQ ID NO: 14384 - protein, 419 aa, Solanum phureja
MFGRAPKKSDNTKYYEILGVPNTASPDDLKKAYRKAAIKNHPDKGGDPEKFKEIAQAYEVLNDPEKREIYDQYGEDALKEGMGGGGGGHDPFDIFQSFFGGGGFGGGGSSRGRRQRRGEDVVHPLKVSLEDLYNGISKKLSLSRNVLCTKCKGAGSKSGASLKCPGCQGKGMKVSIRQLGPMIQQMQHPCNDCRGTGEKINEKDRCPQCKGEKVVQEKKVLEVVVDKGMQNGQKITFPGEADEEPDTVTGDIVFILQQKEHPKFKRKGDDLFVEHTLTLTEALCGFQFVLTHLDNRQLIIKSQPGEVVKPDQFKAINDEGMPMYQRPFMKGKLYIHFTVDFPNILTPELCKNLEAVLPARPKTQASDMELDECEETTLHDVNIDEEMRRKQQQQAQEAYDEDDDDMHGGGAQRVQCAQQ

SEQ ID NO: 14385 - protein, 423 aa, Avena sativa
MFGRGAPKKSDNTRYYEILGVPKDAAPEDLKKAYRKAAIKNHPDKGGDPEKFKELAQAYEVLSDPEKREIYDQYGEDALKEGMGGGGGMHDPFDIFQSFFGGGGGGPFGGGGSSRGRRQRRGEDVVHPLKVSLEELYNGTSKKLSLSRNVLCSKCNGKGSKSGASMKCAGCQGAGYKVQIRQLGPGMIQQMQQPCNECRGTGETISDKDRCGQCKGEKVVQEKKVLEVVVEKGMQHSQKITFPGEADEAPDTVTGDIIFVLQQKEHPKFKRKGDDLFYEHTLTLTEALCGFQYVLTHLDGRQLLIKSNPGEVVKPDSFKAINDEGMPMYQRPFMKGKLYIHFTVDFPDSLNPDQCKALETVLPPKPVSQYTDMELDECEETMAYDIDIEEEMRRRQQQQAQEAYDEDEDMPGGGGQRVQCAQQ

SEQ ID NO: 14386 - protein, 417 aa, Manihot esculenta
MFGRAPKKSDNTRYYEILGVSKNASQDDLKKAYRKAAIKNHPDKGGDPEKFKELAQAYEVLSDPEKREIYDQYGEDALKEGMGGGGGVHNPFDIFESFFGGSPFGGGSSRGRRQRQGEDVVHPLKVSLEDLYLGTTKKLSLSRNVICSKCNGKGSKSGASMKCPGCQGTGVKISVRQLGPSMIQQMQHSCNECKGTGESISEKDKCTQCKGEKVVPEKKVLEVIVEKGMHHGQKITFPGEADEAPDTITGDIVFVLQQKEHPKFKRKGDDLIVEHTLALTEALCGFQFVLTHLDGRQLLIKSNPGDVVKPDSYKGINDEGMPMYQRPFMKGKLYIHFNVEFPDYLAADQVKALEVILPARPSSQLTDMELDVCEETTLHDVNMEEEMRRKQQQARQEAYEEDEDTPSGAQRVQCAQQ

SEQ ID NO: 14387 - protein, 416 aa, Phalaenopsis aphrodite
MFGRAPKKSDNTRYYEILGVSKNASQDDLKKAYRKAAIKNHPDKGGDPEKFKELAQAYEVLSDPEKRDIYDQYGEDALKEGMGGAAHDPFDIFQSFFGGNPFGDRGGGRGRRQRRGEDVIHPLKVSLEELYSGTSKKLSLSRNALCSKCKGKGSKSGASMKCSGCQGSGMKVSIRQLGPSMIQQMQHPCNECKGTGETISDKDRCPQCKGEKVVPEKKVLEVHVEKGMQNGQKITFPGEADEAPDCLTGDIVFVLQQKDHSKFKRKGDDLFVEHTLSLTEALCGFHFILTHLDGRQLLIKSNPGEVVKPDQFKAINDEGMPMYQRPFMRGKLYIHFTVEFPDSLSPEQCKSLESILPARARTQLTDMEIDECEETTLHDVNIEEEMRRKQQSQAQEAYDEDEEMHGGAQRVQCAQQ

SEQ ID NO: 14388 - protein, 420 aa, Lippia dulcis
MFGRAPKKSDNTKYYEILGVSKNASQDDLKKAYRKSAIKNHPDKGGDPEKFKEIAQAYEVLSDPEKREIYDQYGEDALKEGMGGGGGAGHNPFDIFESFFGGSPFGGGGSSRGRRQRRGEDVIHPLKVSLEDLYNGISKKLSLSRNVLCPKCKGKGSKSGASMKCPGCQGSGMKVSIRHLGPSMIQQMQHPCNECKGTGETINDKDRCTQCKGEKVVQEKKVLEVIVEKGMQHGQKVTFPGEADEAPDTVTGDIVFVLQLKEHPKFKRKGDDLFVEHSLTLTEALCGFQFILTHLDSRQLLIKSEPGEVIKPDQFKAINDEGMPMYQRPFMKGKLYIQFSVDFPESLSPEQSKALAAVLPAKPASKLTDMEIDECEETTLHDVNMEEEMRRKQQQRAQEAYEEDDDDMHGGAQRVQCAQQ

SEQ ID NO: 14389 - protein, 418 aa, Tripterygium wilfordii
MFGRPPKKSDNTKYYGILGVSKNASQDDLKKAYRKAAIKNHPDKGGDPEKFKELAQAYEVLSDPEKRELYDQYGEDALKEGMGGGGGGHDPFDIFSSFFGGSPFGGGGSSRGRRQRRGEDVIHPLKVSLEDLYNGTSKKLSLSRNVICSKCKGTGSKSGASMKCSGCQGSGMKVSIRHLGPSMIQQMQHPCNECKGTGEMINDKDRCPQCKGEKVTQEKKVLEVVVEKGMQNGQKITFPGEADEAPDTLTGDIVFVLQEKGHPKFKRKGDDLFVERTLSLTEALCGFHFIISHLDGRQLIIKFQPGEVVKPDQFKAINDEGMPMYQRPFMKGKLYIHFTVEFPDTLTPEQSKALESVLPPRTSTQLTDMELEECEETTLHDVNIEEEMRRKEQQRAQEAYDEDEDMHGGAQRVQCAQQ

SEQ ID NO: 14390 - protein, 361 aa, Raphanus sativus
SDPEKREIYDEYGEDALKEGMGGGGGGGHDPFDIFSSFFGGGSPFGGGGSSRGRRQRRGEDVVHPLKVSLEDLYLDTTKKLSLSRNALCSKCNGKGSKSGASMKCGGCQGTGMKVTIRQLGPGMIQQMQHACNECKGTGETINDRDRCPQCKGDKVVPEKKVLEVNVEKGMQHSQKITFEGQADEAPDTVTGDIVFVIQQKEHPKFKRKGEDLFVEHTLSLTEALCGFSFVLTHLDGRNLLIKSHPGDVVKPDSYKAISDEGMPIYQRPFMKGKLYIHFTVDFPDSLTPDQTKAFEAILPKPSTTQLSDMEIDECEETTLHDVDIEDEMRRKAQAQREAYDDDEGDDDHPGGAQRVQCAQQ

SEQ ID NO: 14391 - protein, 89 aa, Tripterygium wilfordii
MFGRAPKKSDNTKYYEILGVSKNASQDDLKKAYRKAAIKNHPDKGGDPEKFKELAQAYEVLSDPEKRELYDQYGEDALKEGSGGWWWWP

SEQ ID NO: 14392 - protein, 423 aa, Avena sativa
MFGRGAPKKSDNTRYYEILGVPKDAAPEDLKKAYRKAAIKNHPDKGGDPEKFKELAQAYEVLSDPEKREIYDQYGEDALKEGMGGGGGMHDPFDIFQSFFGGGGGGPFGGGGSSRGRRQRRGEDVVHPLKVSLEELYNGTSKKLSLSRNVLCSKCNGKGSKSGASMKCAGCQGAGYKVQIRQLGPGMIQQMQQPCNECRGTGETISDKDRCGQCKGEKVVQEKKVLEVVVEKGMQHSQKITFPGEADEAPDTVTGDIIFVLQQKDHPKFKRKGDDLFYEHTLTLTEALCGFQYVLTHLDGRQLLIKSNPGEVVKPDSFKAINDEGMPMYQRPFMKGKLYIHFTVDFPDSLNPDQCKALETVLPPKPVSQYTDMELDECEETMAYDIDIEEEMRRRQQQQAQEAYDEDEDMPGGGGQRVQCAQQ

SEQ ID NO: 14393 - protein, 420 aa, Brachypodium distachyon
MFGRGPPKKSDNTRYYEILGVPKEASQDDLKKAYRKSAIKNHPDKGGDPEKFKEIAQAYEVLSDPEKREIYDQYGEDALKEGMGGGGGMHDPFDIFQSFFGGSPFGGGGSSRGRRQRRGEDVVHPLKVSLEELYNGTSKKLSLSRNVLCSKCNGKGSKSGASMKCAGCQGAGYKMQIRQLGPGMIQQMQQPCNDCRGTGETISDKDRCPQCKGEKVSQEKKVLEVVVEKGMQHGQKITFPGEADEAPDTLTGDIIFVLQQKEHPKFKRKSDDLFYEHTLTLTEALCGFQYVLTHLDGRQLLIKSNPGEVVKPDSFKAINDEGMPMYQRPFMKGKLYIHFTVDFPDSLNPDQCKALEAVLPPKPASQYTDMELDECEETMAYDIDIEEEMRRRQQQQQQEAYDEDEDMPGGGGQRVQCAQQ

SEQ ID NO: 14394 - protein, 419 aa, Capsicum annuum
MFGRGGKKQSDNTRYYEILGVPKNATEDEIKKAYRKAAMKNHPDKGGDPEKFKELAQAYEVLSDSQKREIYDQYGEDALKEGMGGGGGMHDPFDIFESFFGGNPFGGGGSGRGRRQRRGEDVVHPLKVSLEDLYSGITKKLSLSRNVICSKCSGKGSKSGASTKCSGCKGTGMKVSIRQLGPGMIQQMQHPCNECKGTGETIDDKDRCPQCKGEKVVPEKKVLEVHVEKGMQNGEKITFPGEADEAPDTVTGDIVCVLQQKEHPRFKRKGEDLFVDHTLSLTEASCGFHFILTHLDGRQLLIKSNPGEVVKPDQFKAINDEGMPVYQRPFMKGKLYIHFIVEFPDSLSLEQVQALEAILPARPKSQYSDMELDECEETTLHDVNMEEEMRRKQAAQQEAYDEDEEMPGGGAQRVQCAQQ

SEQ ID NO: 14395 - protein, 416 aa, Phalaenopsis aphrodite
MFGRAPKKSDNTRYYEILGVSKNASQDDLKKAYRKAAIKNHPDKGGDPEKFKELAQAYEVLSDPEKRDIYDQYGEDALKEGMGGAAHDPFDIFQSFFGGNPFGDRGGGRGRRQRRGEDVIHPLKVSLEELYSGTSKKLSLSRNALCSKCKGKGSKSGASMKCSGCQGSGMKVSIRQLGPSMIQQMQHPCNECKGTGETISDKDRCQQCKGEKVVPEKKVLEVHVEKGMQNGQKITFPGEADEAPDCLTGDIVFVLQQKDHSKFKRKGDDLFVEHTLSLTEALCGFHFILTHLDGRQLLIKSNPGEVVKPDQFKAINDEGMPMYQRPFMRGKLYIHFTVEFPDSLSPEQCKSLESILPARARTQLTDMEIDECEETTLHDVNIEEEMRRKQQSQAQEAYDEDEEMHGGAQRVQCAQQ

SEQ ID NO: 14396 - protein, 169 aa, Elaeis guineensis
MFGRAPKKSDNTRYYEILGVSKNASQEDLKKAYRKAAIKNHPDKGGDPEKFKELAQAYEVLSDPEKREIYDQYGEDALKEGMGGGGGHDPFDIFQSFFGGNPFGGGSSRGRRQRRGEDVIHPLKVSLEDLYNGTSKKLSLSRNVICQKCKGKGSKSGASMTCPGCQVQV

SEQ ID NO: 14397 - protein, 316 aa, Beta vulgaris
  misc_feature (281)..(282): Xaa can be any naturally occurring amino acid
MFGRPPKKSDSTRYYEILGVPKNASPEDLKKAYKKAAIKNHPDKGGDPEKFKELAHAYEVLSDPEKREIYDQYGEDALKEGMGGGGGAHDPFDIFSSFFGGSPFGGGGGSSRGRRQRRGEDVIHPLKVSLEDIYNGTSKKLSLSRNVICSKCKGKGSKSGASMKCPGCQGSGVKISIRHLGPSMIQQMQHACNECKGTGETINDRDRCLQCKGEKAVQEKKVLEVHVEKGMQNGQKITFPGEADEAPDTVTGDIVFILQQKEHSKYKRKGDDLFYEHTFPXXALVVFSCMTHLDIDSVNQISAWRSCKARLLQSNK

SEQ ID NO: 14398 - protein, 313 aa, Platanus occidentalis
MFGRAPKKSDNTRYYEILGVSNSASQEDLKKAYRKAAIKNHPDKGGDPEKFKELAQAYEVLSDPEKREIYDQYGEDALKEGMGGGAGGHDPFDIFQSFFGGGGSPFGGGGSSRGRRQRKGEDVIHPLKVSLEDLYSGTSKKLSLSRNVLCSKCKGKGSKSGASMTCASCQGSGMKVSIRHLGPSMIQQMQHPCNECKGTGETINDKDRCPQCKGEKVLPEKKVLEVIVEKGMQNGQRITFPGEADQAPDTATGDIVFVLQQKEHPKFKRKGDDLFYEHTLSLTEALCGFQFIITHLDNRQLLIKSNPWGSHQT

SEQ ID NO: 14399 - protein, 418 aa, Cenchrus ciliaris
  misc_feature (7)..(9): Xaa can be any naturally occurring amino acid
  misc_feature (102)..(102): Xaa can be any naturally occurring amino acid
  misc_feature (105)..(107): Xaa can be any naturally occurring amino acid
MFGRAPXXXNNTRYYEILGVPKDASQDDLKKAYRKAAIKNHPDKGGDPEKFKELAQAYEVLSDPEKREIYDQYGEDALKEGMGGGGGMHDPFDIFQSFFGGXSPXXXGGSSRGRRQRRGEDVVHPLKVSLDELYNGTSKKLSLSRNVLCSKCNGKGSKSGASSRCAGCQGSGYKVQIRQLGPGMIQQMQHPCNECKGTGETINDKDRCPQCKGEKVVQEKKVLEVVVEKGMQNGQKITFPGEADEAPDTVTGDIIFVLQQKEHPKFKRKGDDLFYEHTLTLTESLCGFQFVLTHLDNRQLLIKSNPGEVVKPDSFKAINDEGMPMYQRPFMKGKLYIHFSVEFPDFLNPEQCKALEAVLPPKPTSQYTDMELDECEETMPYDVNIEEEMRRRQQQHQEAYDEDEDMPGGAQRVQCAQQ

SEQ ID NO: 14400 - protein, 405 aa, Silene vulgaris
RYYEILGVSQNATPDELKKAYKKAAIKNHPDKGGDPEKFKELAHAYEVLSDPEKREIYDQYGEDALKEGMGGGGGMHDPFDIFSSFFGGNPFGGGGSSRGRRQRRGEDVIHPLKVSLEDLYSGTTKKLSLSRNVICSKCSGKGSKSGASVTCGGCQGTGMKVSVRHLGPSMIQQMQHPCNECKGTGETISDKDRCPQCKGDKVVPEKKVLEVVVERRMQNGQKITFTGEADEAPETITGDIVFVLQQKDHPKFKRKGPDLFYEHTLSLTEALCGFRFVLTHLDGRQLLIKSNPGEVIKPDQFKAIDDEGMPIYQRPFMKGKMYIHFTVEFPDSLSPDQVTALEAVLPPKPSMLLSDMELDECEETTMHDVNIEEEMRRRQAQAQQEAYDEDDEPQGGQRVQCAQQ

SEQ ID NO: 14401 - protein, 410 aa, Fragaria vesca
MFGRGVPKKSDNSKYYEILGVPKTASQDDLKKAYRKAAIKNHPDKGGDPEKFKELAQAYEVLSDPEKREIYDQYGEDALKEGMGGGGGAHDPFDIFQSFFGGGSRRQRRGEDVIHPLKVSLEDLYSGTSKKLSLSRNIICSKCKGKGSKSGASIKCPGCQGSGMKVSIRHLGPSMIQQMQHPCNECKGTGETINDKDRCQLCKGEKVVQEKKVLEVHVEKGMQNGQRITFPGEADEAPDTVTGDIVFVLQQKEHPKFKRKGDDLFYEHTLSLMEALCGFQFVLTHLDSRQLLIKSHPGEVVKPDQFKAINDEGMPMYQRAFMKGKLYIHFTVEFPDSLNPEQCKTLEAVLPPRSSTQLTDMELDECEETTLHDVNIEEEMRRKQGQQSQEAYDEDEDMHGGAQRVQCAQQ

SEQ ID NO: 14402 - protein, 419 aa, Vinca minor
MFGRAPKKSDNSKYYEILGVSKNASQEDLKKAYRKAAIKNHPDKGGDPEKFKELAQAYEVLSDVEKREIYDQYGEDALKEGMGGGGGGVHDPFDIFSSFFGGASPFGGGSSRGRRQRRGEDVIHPLKVSLEDLYNGTSKKLSLSRNVLCQKCKGKGSKSGASMKCSGCKGSGMKVSIRHLGPSMIQQMQHPCNECKGTGEAINDKDRCPQCKGEKIVQEKKVLDVIVEKGMQNGQKITFPGEADEAPETVTGDIVFVLQQKEHPKFKRKGDDLFVEHTLSLTEALCGFQFILTHLDNRQLLIKSQPGEVIKPDQFKAINDEGMVIYQRPFMRGKLYIHFNVEFPESLSTENCEALEHVLPPRPTKQITEMELDECEETTLHDVNIEEEMRRKSQQAAQEAYDEDEDMPGGAQRVQCAQQ

SEQ ID NO: 14403 - protein, 417 aa, Aquilegia formosa
MFGRAPKKSDNTKYYEILGVSKNASQDDLKKAYKKAAIKNHPDKGGDPEKFKELGQAYDVLSDPEKREIYDQYGEDEVNNGMGGGGGGHDPFDIFQSFFGGSPFGGGGSSRGRRQTRGKDVVHPLKVSLEDLHNGLSKKLSLSRNVICSKCKGKGSKSGASMTCPGCQGAGVKVSIRHLGPSMIQQMQHPCNECKGTGEAISDRDRCPQCKGEKVVPEKKMLGVHVEKGMQNGQRITFPGEADEAPDTVTGDVVFVLQQKEHPKFKRKGDDLYVEHSLSLTEALCGFQFILTHLDNRQLLIKSNPGEVVKPDQYKAINDEGMPMYQRPFMRGKLYIHFTVEFPDSLTPEQSKALETVLPPRTSVQLTDMELDECEETTLHDVNIEEEMRRKQSQAREAYEDDEDMHGGAQRVQCAQQ

SEQ ID NO: 14404 - protein, 317 aa, Flaveria ramosissima
MFGRAPKKSDNTKYYEILGVPQNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCAQCKGEKVVQEKKVLEVHVEKGMQNGQKITFPGEADEAPDTITGDIVFVLQQKEHPKFKRKGDDLFVEHTLSLTEALCGFQFILTHLDNRQLLIKSQPGEVVKPDQFKA

SEQ ID NO: 14405 - protein, 401 aa, Flaveria ramosissima
MFGRAPKKSDNTKYYEILGVPKNASQDDLKKAYRKAAIKNHPDKGGDPEKFKELAQAYEVLSDPEKREIYDQYGEDALKEGMGGGGGGHDPFDIFQSFFGGSPFGGGSGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFVEHTLSLTEALCGFQFILTHLDNRQLLIKSQPGEVVKPDQFKAINDEGMPMYQRPFMRGKLYLHFTVEFPDSLSPDQCKALEAVLPPKPSMQMTDMELDECEETTLHDVNIEEEMRRKQQAAQEDL

SEQ ID NO: 14406 - protein, 245 aa, Amorphophallus konjac
MFGRAPKKSDNTRYYEILAVPKDASQDDLKRAYRKAAIKNHPDKGGDPEKFKELAQAYEVLSDPEKREIYDQYGEDALKEGMGGGGGHDPFDIFQSFFGGNPFGGSSRGRRQKRGEDVIHPLKVSLEDLYSGTSKKLSLSRNVICSKCKGKGSKSGASMRCAGCQGSGMKVSIRQLGPGMINKCSTRAMSARGPERPSTRRTGALSAKVRRWCRRRKSWRFTLRRGCRMARRSHSLEKLMKRLTV

SEQ ID NO: 14407 - protein, 415 aa, Elaeis guineensis
  misc_feature (5)..(5): Xaa can be any naturally occurring amino acid
  misc_feature (107)..(107): Xaa can be any naturally occurring amino acid
  misc_feature (288)..(288): Xaa can be any naturally occurring amino acid
MFGRXPKKSDNTRYYEILGVPKNASQDDLKKAYRKAAIKNHPDKGGDPEKFKELAQAYEVLSDPEKREIYDQYGEDALKEGMGGGGGGHDPFDIFQSFFGGNPFGGXGSSRGRRQRRGEDVIHPLKVSLEDLYNGTSKKLSLSRNVICQKCKGKGSKSGASMKCAGCQVPYEVSIRQLDFHDSTNAAPLHECKGTGETINEKDRCPQCKGEKVVQEKKVLQVVVEKGMQNGQKITFPGEADEAPDTVTGDIVFVLQQKDHPKFKRKGDDLFFEHTLSLTEALCGFQFXLTHLDNRQLLIKSNPGEVVKPDQFKAINDEGMPLYQRPFMRGKLYIHFAVDFPDSLTPDQCKAIEAVLPPKPVSQLTDMEIDECEETTLHDVNIEEEMRRKQAQAQEAYEEDEEAHGGAQRVQCAQQ

SEQ ID NO: 14408 - protein, 421 aa, Pseudoroegneria spicata
  misc_feature (11)..(11): Xaa can be any naturally occurring amino acid
  misc_feature (358)..(358): Xaa can be any naturally occurring amino acid
MFGRGPPKKSXNTRYYEILGVPKDASQDDLKKAYRKAAIKNHPDKGGDPEKFKELAQAYEVLSDPEKREIYDQYGEDALKEGMGGGGMHDPFDIFQSFFGGGGNPFGGGGSSRGRRQRRGEDVVHPLKVSLEELYNGTSKKLSLARNVLCSKCNGKGSKSGASMKCAGCQGAGYKVQIRQLGPGMIQQMQQPCNECRGSGETISDKDRCGQCKGEKVVHEKKVLEVVVEKGMQHGQKITFPGEADEAPDTVTGDIIFVLQQKEHPKFKRKGDDLFYEHTLTLTEALCGFQYVLTHLDGRQLLIKSNPGEVVKPDSFKAINDEGMPMYQRPFMKGKLYIHFTVDFPDSLSLDQCKALEXVLPPKPASQYTDMELDECEETMAYDIDIEEEMRRRQQQQAQEAYDEDEDMPGGGGQRVQCAQQ

SEQ ID NO: 14409 - protein, 422 aa, Leymus cinereus x Leymus triticoides
MFGRGPPKKSDSTRYYEILGVPKDASQDDLKKAYRKAAIKNHPDKGGDPEKFKELAQAYEVLSDPEKREIYDQYGEDALKEGMGGGGMHDPFDIFQSFFGGGGNPFGGGGSSRGRRQRRGEDVVHPLKVSLEELYNGTSKKLSLARNVLCSKCNGKGSKSGASMKCAGCQGAGYKVQIRQLGPGMIQQMQQPCNECRGSGETISDKDRCGQCKGEKVVHEKKVLEVVVEKGMQHGQKITFPGEADEAPDTVTGDIIFVLQQKEHPKFKRKGNDLFYEHTLTLTEALCGFQYVLAHLDGRQLLIKSNPGEVVKPDSFKAINDEGMPMYQRPFMKGKLYIHFTVDFPDSLSLDQCKALETVLPPKPASQYTDMELDECEETMAYDIDIEEEMRRRQQQQAQEAYDEDEDMPGGGGGQRVQCAQQ

SEQ ID NO: 14410 - protein, 423 aa, Fragaria vesca
MFGGGRAAKKSDNSKYYEVLGVSKTASPDDLKKAYKKAAIKNHPDKGGDPEKFKELAQAYEVLSDPEKREIYDQYGEDGLKDGGPPGHDPFDIFSSFFGGGGSPFGGMPGGGSSRGRRQRRGEDVVHSLKVSLEDLYLGTSKKLSLSRNVLCSKCKGKGSKSGASTKCGGCQGTGMKVTIRHLGPSMIQQMQHACNECKGTGETISDKDRCGQCKGEKVAQEKKVLEVHVEKGMQNGQKITFPGEADEAPDTITGDIVFIIQQKEHPKFKRKGDDLFVEHSLLLTDALCGFQFVLNHLDGRQLLIKSNPGEVVKPDSFKAVNDEGMPMYGRPFMKGKLYIHFSVEFPETLSLEQVKALEAALPTRASSQQLTDMELDECEETTLHDVNMEEEMRRKQHHAHSEAYDEDEDMPGGAQRVQCAQQ

SEQ ID NO: 14411 - protein, 421 aa, Triphysaria pusilla
MFGRAPKKSDNTKYYQILGVSKNASQDDLKKAYRKLAIKNHPDKGGDPEKFKEIAQAYEVLSDSEKREIYDQYGEDALREGMGGGGGGGHNPFEFFENMFGGSPFGGGGGPSRGRRQRRGEDVQHHLKVSLEDLYNGTLKKLSLSRNVLCSKCKGKGSKSGASLKCSGCQGSGVKVSIRHLGPSMIQQMQHACNECKGTGETINDKDRCTQCKGEKIVQEKKVLEVVVEKGMQHSQKITFPGEADEAPDTVTGDIVFLLQQKEHPKFKRKGDDLFVEHTLTLTEALCGFQFILTHLDNRQLLIKSEPGEIVKPDQFKAINDEGMPMYQRPFMKGKLYIHFTVDFPESLRPEQNKALEVVLPPRPSNCLTDMKLEECEETTLHDINMEEEMHRKQQAAHEAYDEDDDDLHEGGAQRVQCAQQ

SEQ ID NO: 14412 - protein, 403 aa, Flaveria ramosissima
MFGRAPKKSDNTKYYEILGVPQNASQDDLKKAYRKAAIKNHPDKGGDPEKFKELAQAYEVLSDPEKREIYDQYGEDALKEGMGGGGGGHDPFDIFQSFFGGSPFGGGGGSSRGRRQRRGEDVVHPLKVSLEDLYNGTSKKLSLSRNVICSKCKGKGSKSGASMKCAGCQGSGMKVSIRHLGPSMIQQMQHPCNECKGTGETINDKDRCTQCKGEKVVQEKKVLEVHVEKGMQNGQKITFPGEADEAPDTVTGDIVFVLQQKEHPKFKRKGDDLFVEHSLSLTEALCGFQFILTHLDNRQLLIKSQPGEVVKPDQFKAINDEGMPMYQRPFMRGKLYLHFTVEFPDSLSSDQCKALEAVLPSRPSMQMTDMELDECEETTLHDVNIEEEMRRKQQAAQEAYDED

SEQ ID NO: 14413 - protein, 382 aa, Cleome gynandra
TAIKTNPDKGGDPEKFKELAQAYEVLSDPEKREIYDQYGEDALKEGMGGPGGGHDPFDIFSSFFGGSPFGGGSSRGRRQRRGEDVVHPLKVSLEDLYVGLSKKLSLTRNALCSKCNGKGSKSGASMTCAGCQGTGMKVTIRQLGPGMIQQMQHACNECKGTGETINDRDRCPQCKGDKVVPEKKVLEVHVEKGMQHSQKITFSGQADEAPDTVSGDIVFVLQQKEHPRFKRKGDDLFVEHSLSLTEALCGFQFALTHLDGRQLLIRSNPGEVVKPDSYKAINDEGMPIYQRPFMKGKLYIHFSVDFPDTLSLDQAKALEAVLPPRPSTSQLTDMEIDECEETTLHDVNMEEEMRRKQQAQREAYEDDDDEPHGGQRVQCAQQ

SEQ ID NO: 14414 - protein, 422 aa, Plantago ovata
MFGRAPKKSDNTKYYELLGVPKTASPDDLKKAYRKSAIKNHPDKGGDPEKFKEIAQAYEVLSDPEKREIYDQYGEDALKEGMAGGGAGGHNPFDIFESFFGGGGGNPFGGGGSSRGRRQRRGEDVVHPLKVSLEDLYSGISKKLSLSRNVLCSRCKGKGSKSGASTKCSGCHGSGMKVSIRHLGPSMIQQMQHPCNECKGTGETITDKDRCTQCKGEKVAQEKKVLEVNVEKGMQHGQKITFPGAADEAPDTVTGDIVFVLQQKEHPKFKRKGDDLFVQHTLTLTEALCGFQFILTHLDNRQLLIKSEPGEVVKPDQYKAINDEGMPIYQRNFMRGKLYIQFAVEFPESLSPELSKSLESVLPPRTSSQMSDMELDECEETTLHDVNMEEELRRKQHQHAQEAYEEDDDMPGGAQRVQCAQQ

SEQ ID NO: 14415 - protein, 421 aa, Triticum aestivum
MFGRGPPKKSDSTRYYEILGVPKDASQDDLKKAYRKAAIKNHPDKGGDPEKFKELAQAYEVLSDPEKREIYDQYGEDALKEGMGGGGMHDPFDIFQSFFGGGGNPFGGGGSSRGRRQRRGEDVVHPLKVSLEELYNGTSKKLSLARNVLCSKCNGKGSKSGASMKCAGCQGAGYKVQIRQLGPGMIQQMQQPCNECRGSGETISDKDRCGQCKGEKVVHEKKVLEVVVEKGMQHGQKITFPGEADEAPDTVTGDIIFVLQQKEHPKFKRKGDDLFYEHTLTLTEALCGFQYVLAHLDGRQLLIKSNPGEVVKPDSFKAINDEGMPMYQRPFMKGKLYIHFTVDFPDSLSLDQCKALETVLPPKPASQYTDMELDECEETMAYDIDIEEEMRRRQQQQAQEAYDEDEDMPGGGGQRVQCAQQ

SEQ ID NO: 14416 - protein, 416 aa, Pseudotsuga menziesii
MFGARAPKKSDNTRYYEVLGVPKSASQDELKKAYRKAAIKNHPDKGGDPEKFKELAQAYEVLSDPEKREVYDQYGEDALKEGMGGGGGHDPFDIFQSFFGGSPFGGGGSSRGSRRQRRGEDVVHPLKVSLEDLYNGTSKKLSLSRNVLCSKCKGKGSKSGASMKCSGCQGSGMKVSIRHLGPSMIQQMQHVCSDCRGTGETINEKDRCPQCKGEKVLPEKKMLEVTVDKGMQNGQRITFQGEADEAPDTVTGDIVFVVQQKEHPKFKRKGDDLFVEHTLSLTEALCGFQFILTHLDGRQLLIKSSPGEVVKPGQFKAINDEGMPAYQRPFMKGNLYIHFSVDFPDSFTPEQCKALEAVLPPRSASQLTDMELDECEETTLHDVNYEEEMRKKQSQQEAYEEDEEGSGGPRVQCAQQ

SEQ ID NO: 14417 - protein, 421 aa, Hordeum vulgare
MFGRGPPKKSDSTRYYEILGVPKDASQDDLKKAYRKAAIKNHPDKGGDPEKFKELAQAYEVLSDPEKREIYDQYGEDALKEGMGGGGMHDPFDIFQSFFGGGGNPFGGGGSSRGRRQRRGEDVVHPLKVSLEELYNGTSKKLSLARNVLCSKCNGKGSKSGASMKCAGCQGAGYKVQIRQLGPGMIQQMQQPCNECRGSGETISDKDRCGQCKGEKVVHEKKVLEVVVEKGMQHGQKITFPGEADEAPDTVTGDIIFVLQQKEHPKFKRKADDLFYEHTLTLTEALCGFQYVLAHLDGRQLLIKSNPGEVVKPDSFKAINDEGMPMYQRPFMKGKLYIHFTVVFPDSLSLDQCKALETVLPPKPASQYTDMELDECEETMAYDIDIEEEMRRQQQQQAQEAYDEDEDMPGGGGQRVQCAQQ

SEQ ID NO: 14418 - protein, 188 aa, Ambrosia trifida
MFGRAPKKSDNTKYYEILGVPKNASQDDLKKAYRKAAIKNHPDKGGDPEKFKELAQAYEVLSDPEKREIYDEYGEDALKEGMGGGGGGHDPFDIFSSFFGGGGGGSSRGRRQRRGEDVVHPLKVSLEDLYNGTSKKLSLSRNVICSKCKGKGSKSGASMKRAGCQGSGMKVSIRHLGPSMIQQIAASL

SEQ ID NO: 14419 - protein, 414 aa, Cirsium arvense
PKKSDNTKYYEILGVPNTASQDDLKKAYRKAAIKNHPDKGGDPEKFKELAQAYEVLSDPEKRQIYDEYGEDALKEGMGGGGGGHDPFDIFQSFFGGSPFGGGGSSSRGRRQRRGEDVIHPLKVSLEDLYNGTSKKLSLSRNVICSKCTGKGSKSGASMKCSGCQGSGMKVSIRHLGPSMIQQMQQPCNECKGTGETIDDKDRCPQCKGEKVVPEKKVLEVHVEKGMQNGQKITFPGEADEAPDTVTGDIVFVLQQKEHPKFKRKGDDIFYEHTLNLTEALCGFQFILTHLDNRQLLIKSLPGEVVKPDQFKAINDEGMPMYSRPFMKGKLYIHFSIDFPDSISPEQSKVLESVLPGRPSVQITDMEVDECEETTLHDVNIEEEMRRKQQQAAYDEDDDDDDMHAGAQKVQCAQQ

SEQ ID NO: 14420 - protein, 128 aa, Allium cepa
MFGRAPKKSDNTKYYEILGVSKNASPDDLKKAYRKAAIKNHPDKGGDPEKFKELAQAYEVLSDPEKREIYDQYGEDALKEGWVEGGGGHDPFDIFQSFFGGEVLEVVVAAGAVDKEEAKMWYILSKYL

SEQ ID NO: 14421 - protein, 419 aa, Triphysaria pusilla
MFGRAPKKSDNTKYYEILGVSKNASPDDLKKAYRKLAIKNHPDKGGDPEKFKEIAQAYEVLNDPEKREIYDQYGEDALKEGMGGGGGGHSEFDLFENLFGGHPFGGGGGPSRGRRQRRGEDVQHPLKVSLEELYNGTSKKLSLSRNKLCTKCKGKGSKSGASTKCSGCQGSGMKVSIRHLGPSMIQQMQHPCNECKGTGEMISDKDRCTQCKGEKVVQEKKVLEVVVEKGMQHGQKIKFPGEADEAPDTVTGDIVFVLQQKEHPKFKRKGDDLFLEHTLTLTEALCGFQFVLTHLDNRQLLIKSEPGEVIKPDQFKAINDEGMPIYQRSFMKGKLYVQFTVDFPDSLSPEQSKALEAVLPTKPTTSLTDMELDECEETTLHDINMEEEMRRKQQSAHEAYDEDDDMHGGGGQRVQCAQQ

SEQ ID NO: 14422 - protein, 403 aa, Momordica charantia
ILGVPKSASQDDLKKAYRKAAIKNHPDKGGDPEKFKELAQAYEVLSDPEKREIYDQYGEDALKEGMGGGGGHVDPFDIFSSFFGPSFGGGGGSSRGRRQRRGEDVVHPLKVSLEDLYNGTSKKLSLSRNVICSKCKGKGSKSGASMRCPGCQGSGMKVTIRQLGPSMIQQMQTACNECKGTGESINEKDRCPGCKGEKVVQEKKVLEVHVEKGMQHGQKITFPGEADEAPDTTTGDTVFVLQQKDHSKFKRKGDDLFYEHTLSLTEALCGFQFVLTHLDNRQLLIKSNPGEVVKPDQFKAINDEGMPMYQRPFMKGKLYIHFTVEFPDSLAPEQCKALEAVLPPKPTSKLTDMEIDECEETTMHDVNNIEEEMRRKQAHAAQEAYEEDDDMPGGAQRVQCAQQ

SEQ ID NO: 14423 - protein, 361 aa, Arabidopsis lyrata
MRKWICCTCQIEDSNEEQQLKSSQQQSDANHKNPKPAPVAKHEMKKEALPIEVPPLSLDEVKEKTENFGSKALIGEGSYGRVYYATLNDGVAVALKKLDVAPEAETDAEFLSQVSMVSRLKHENLIQLLGFCVDGNLRVLAYEFATMGSLHDILHGRKGVQGAQPGPTLDWITRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYEAEFRPNMSIVVKALQPLLKPPAAAPAPES

SEQ ID NO: 14424 - protein, 361 aa, Arabidopsis thaliana
MRKWICCTCQIEDSNEEQQLKSSQQQSDANHKNSKPAPVAKHEVKKEALPIEVPPLSLDEVKEKTENFGSKALIGEGSYGRVYYATLNDGVAVALKKLDVAPEAETDTEFLSQVSMVSRLKHENLIQLLGFCVDGNLRVLAYEFATMGSLHDILHGRKGVQGAQPGPTLDWITRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYEAEFRPNMSIVVKALQPLLKPPAAAPAPES

SEQ ID NO: 14425 - protein, 365 aa, Eutrema halophilum
MRKWICCTCQIEDSNEEEHLKSSQQQSDANHKNPKPAPAAKHEVQKEALPIEVPPLSLDEVKEKTENFGSKALIGEGSYGRVYYATLNDGIAVALKKLDVAPEAESDAEFLSQVSMVSRLKHENLIQLLGFCVDGNVRVLAYEFATMGSLHDILHGRKGVQGAQPGPTLDWITRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYEAEFRPNMSIVVKALQPLLKSPPPPPAPSPAPES

SEQ ID NO: 14426 - protein, 367 aa, Eutrema parvulum
MRKWICCTCQIEDSNEEEQLKSSQQQSDANHKNPKPAAVAKHEVQKEALPIEVPPLSLDEVKEKTENFGSKALIGEGSYGRVYYATLNDGIAVALKKLDVAPEAESDAEFLSQVSMVSRLKHENLIQLLGYCVDGNLRVLAYEFATMGSLHDILHGRKGVQGAQPGPTLDWITRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKTDYPPKAVAKLAAVAALCVQYEAEFRPNMSIVVKALQPLLKSPPPAPSPSPSPAPES

SEQ ID NO: 14427 - protein, 364 aa, Brassica napus
MRKWICCTCQIQDSNEEEHLKSSQQPSDANHKVPKPAAVAKHEVQKEEHLPVEVPPLSLDEVKEKTENFGSKALIGEGSYGRVYYATLNDGVAVALKKLDVSPEAESDAEFLSQVSMVSRLKHENLVQLLGFCVDGSLRVLAYEFATMGSLHDILHGRKGVQGAQPGPTLDWTTRVKIAVEAARGLEYLHEKSQPAVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYESEFRPNMSIVVKALQPLLKLAAPAPSPAPES

SEQ ID NO: 14428 - protein, 365 aa, Brassica rapa
MRKWICCTCQIQDSTEEEHLKSSHQQSDATNHKNPKPAAVAKSDAQKEPLPVEVPPLSLDEVKEKTENFGSKALIGEGSYGRVYYATLNDGVAVALKKLDVSPEAESDAEFLSQVSMVSRLKHENLVQLLGFCVDGSLRVLAYEFATMGSLHDILHGRKGVQGAQPGPTLDWTTRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYESEFRPNMSIVVKALQPLLKVAVPAPPSPAPES

SEQ ID NO: 14429 - protein, 366 aa, Brassica napus
MRKWICCTCQIQDSSEEEHLKSSQQQSDANHKVPKPAAVAKHEAEVQKEPLPVEVPPLSSDEVKEKTENFGSKALIGEGSYGRVYYATLNDGVAVALKKLDVSPEAESDAVFLSQVSMVSRLNHENLVQLLGFCVDGSLRVLAYEFATMGSLHDILHGRKGVQGAQPGPTLDWTTRVKIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYESEFRPNMSIVVKALQPLLKLAAPAPPSPAPES

SEQ ID NO: 14430 - protein, 352 aa, Brassica napus
ICCTCQIQDSNEEEHLKSSHQQSDANHKNPKPAAVAKSDAQKEPLPVEVPPLSLDEVKEKTENFGSKALIGEGSYGRVYYATLNDGVAVALKKLDVSPEAESDAEFLSQVSMVSRLKHENLVQLLGFCVDGSLRVLAYEFATMGSLHDILHGRKGVQGAQPGPTLDWTTRVRIAVEAARGLEYLHEKSQPPVIHRDIRSSNVLLFEDYKAKIADFNLSNQAPDNAARLHSTRVLGTFGYHAPEYAMTGQLTQKSDVYSFGVVLLELLTGRKPVDHTMPRGQQSLVTWATPRLSEDKVKQCIDPKLKADYPPKAVAKLAAVAALCVQYESEFRPNMSIVVKALQPLLKLAAPA

SEQ ID NO: 14431 - protein, 361 aa, Malus domestica
MRRWLCCACHVEESYPSNENERLKSPNHYGDGNQKGSKVSAPVKSEVQKAAPPIEVPQLSVEELKEKTDNFGSKSLIGEGSYGRVYYASLNDGKAVAVKKLDVASEPETNVEFLTQVSMVSRLKHENLVELLGYCVDGNLRVLAYEFATMGSLHDILHGRKGVQGAQPGPTLDWMQRVRIAVEAARGLEYLHEKVQPAIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKDYPAKGVAKLAAVAALCVQYESEFRPNMSIVVKALQPLLKPPAAAPES

SEQ ID NO: 14432 - protein, 363 aa, Brassica napus
MCKWMCCTCQIQDSHEEEHLKSSHQHHHSDANHKNPKPPAVAKPEVRKEPLPIEVPALSLDEVKEKTDNFGSKSLIGEGSYGRVYYGTLNDGVAVALKKLDAAPEAESDSEFLSQVSMVSRLKHENLVQLLGFCVDGKLRVLAYEFATMGSLHDVLHGRKGVQGAQPGPTLDWTTRVKIAVEAARGLEYLHEKSQPPVIHRDIRSSNVLLFEDYKPKIADFNLSNQSPDNAARLHSTRVLGTFGYHAPEYAMTGQLTQKSDVYSFGVVLLELLTGRKPVDNNMPRGQQSLVTWATPRLSEDKVKECIDPKLQADYPPKAVAKLAAVAALCVQYEAEFRPNMSIVVKALQPLLKPPPPAAAPSS

SEQ ID NO: 14433 - protein, 361 aa, Malus domestica
MRRWLCCTCHVEESYPSNENEHLKSPKHYADGNQKGSKVSAPVKSEVQKAAPPIEVPQLSVEELKEKTDNFGSKSLIGEGSYGRVYYASLNDGKAVAVKKLDVASEPETNVEFLTQVSMVSRLKHENLVELLGYCVDGSLRVLAYEFATMGSLHDILHGRKGVQGAQPGPTLGWMQRVRIAVDAARGLEYLHEKVQPAIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKDYPAKGVAKLAAVAALCVQYESEFRPNMSIVVKALQPLLKPPAAAPES

SEQ ID NO: 14434 - protein, 362 aa, Medicago truncatula
MRRWLCCTCQVEESYPSNENEHLKSPRSYGDGNPKGSRAPAPVKPETQKAPPPIEVPALSLDELKEKTDNFGSKALIGEGSYGRVYYATLNDGKAVAVKKLDVSTEPESNNEFLTQVSMVSRLKNENFVELHGYCVEGNLRVLAYEFATMGSLHDILHGRKGVQGAQPGPTLNWMQRVRIAVDAARGLEYLHEKVQPSIIHRDIRSSNVLIFEDYKAKVADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKAPAPAPET

SEQ ID NO: 14435 - protein, 366 aa, Glycine max
MRRWLCCTCQVEESYPSNENEHLKSPRNYGDGNQKGSKVSAPVKPETQKAPPPIEAPALSLDELKEKTDNFGSKALIGEGSYGRVYYATLNNGKAVAVKKLDVSSEPESNNEFLTQVSMVSRLKDDNFVELHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLGAVAALCVQYEAEFRPNMSIVVKALQPLLKSPAPAPAPVPES

SEQ ID NO: 14436 - protein, 362 aa, Vigna unguiculata
MRRWLCCTCQVEESYPSNENEHLKSPRNYGDSNQKGSKVSAPVKPETQKAPPPIEAPALSLDELKEKTDNFGSKALIGEGSYGRVYYATLNNGKAVAVKKLDVSSEPESNNEFLTQVSMVSRLKNDNFVELHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKTPAPAPES

SEQ ID NO: 14437 - protein, 363 aa, Glycine max
MRRWLCCTCQVEESYPSNENEHLKSPRNYGDGNQKGSKVSAPVKPETQKAPPPIEAPALSLDELKEKTDNFGSKALIGEGSYGRVYYATLNNGKAVAVKKLDVSSEPESNNEFLTQVSMVSRLKNGNFVELHGYCVEGNLRVLAYEFATMGSLHDILHGRKGVQGAQPGPTLDWIQRVRIAVDAARGLEYLHEKVQPPIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKSPAPAAPES

SEQ ID NO: 14438 - protein, 362 aa, Fragaria vesca
MRRWLCCSCHVDESYPSHESEHLKSPGSYADGNHKGSKAPAPMKPDIQKAAPPIEVPPLSLEELKEKTDNFGSKSLIGEGSYGRVYYASMDDGKAVAVKKLDVASEPESNVEFLTQVSMVSRLRHDNLVELLGYCVEGSLRVLAYEFATMGSLHDILHGRKGVQGAQPGPTLDWMQRVRIAVDAARGLEYLHEKVQPPIIHRDIRSSNVLLFEDFKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKPPAPALES

SEQ ID NO: 14439 - protein, 364 aa, Phaseolus coccineus
MRRWLCCTCQVEESYPSNENEHLKSPRNYGDSNQKGSKVLPPVKPETQKAPPPIEAPALSLDELKEKTDNFGSKALIGEGSYGRVYYATLNNGKAVAVKKLDVSSEPESNNEFLTQVSMVSRLKNDNFVELHGYCVEGNLRVLAYEFATMGSLHDILHGRKGVQGAQPGPTLDWIQRVRIAVDAARGLEYLHEKVQPPIIHRDIRSSNVLIFEEYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKTPAPAPAPES

SEQ ID NO: 14440 - protein, 364 aa, Lotus japonicus
MRRWLCCTCQVEEPYPSNENDHLKSPRNYGDGNSKGSKASAPVKHETQKAPPPIEVPALSLDELKEKTDNFGSKALIGEGSYGRVYYATLNDGNAVAVKKLDVSSEPETNNEFLTQVSMVSRLKNDNFVELHGYCVEGNLRVLAYEFATMGSLHDILHGRKGVQGAQPGPTLDWIQRVRIAVDAARGLEYLHEKVQPAIIHRDIRSSNVLIFEDYKAKIADFNLSNQAPDMAARLHSTRVLGTFGYHAPEYAMTGQLTQKSDVYSFGVVLLELLTGRKPVDHTMPRGQQSLVTWATPRLSEDKVKQCVDPKLKGEYPPKGVAKLAAVAALCVQYEAEFRPNMSIVVKALQPLLKTPAAAPAPEN

SEQ ID NO: 14441 - protein, 106 aa, Theobroma cacao
MAKLVAAFLLALIAFSMLQTMVMASHGHGGHHYDQKHYGPGSLKSSQCPTQCSRRCSKTQYHKPCMFFCQKCCRKCLCVPPGYYGNKAVCPCYNNWKTKEGGPKCP

SEQ ID NO: 14442 - protein, 107 aa, Manihot esculenta
MAKFVAVFLLALIAISMLQTLVMASHGHGGHHYNNQNSYGPGSLKSYQCPSQCSRRCSKTQYHKPCMFFCQKCCRKCLCVPPGYYGNKAVCPCYNNWKTKEGGPKCP

SEQ ID NO: 14443 - protein, 107 aa, Manihot esculenta
MAKFVAAFFLALIALSMLQTLVMSSHGHGGHHYNSQRRYGPGSLKSYQCPSQCSRRCSKTQYHKPCMFFCQKCCRKCLCVPPGYYGNKAVCPCYNNWKTKEGGPKCP

SEQ ID NO: 14444 - protein, 107 aa, Fagus grandifolia
MAKFVATLFLALIALSMLQTMVMASHGHGGHHYDNTSKYGQGSLKSYQCPSQCSRRCSKTQYHKPCMFFCQKCCKKCLCVPPGYYGNKAVCPCYNNWKTKEGGPKCP

SEQ ID NO: 14445 - protein, 106 aa, Gossypium hirsutum
MAKLVATFFLALIAISMVQTLVMASHGHGGHHYDNKRYGPGSLKPYQCPSQCTRRCSQTQYHKPCMFFCQKCCRTCLCVPPGYYGNKQVCPCYNNWKTKEGGPKCP

SEQ ID NO: 14446 - protein, 106 aa, Tropaeolum majus
MAKFAAFFLLALIAISMLQTMVLASHGHGGHHFDKKHFGPGSLKSYQCPTQCTRRCSRTQYHKPCMFFCQKCCSKCLCVPPGFYGNKAVCPCYNNWKTKEGGPKCP

SEQ ID NO: 14447 - protein, 106 aa, Sarracenia psittacina
MPKVAAFFLFTLLAISMLQLMVLASHGHGGHHLNSSPYGSGSLKSSQCPSQCSRRCSQTQYHKPCMFFCQKCCNKCLCVPPGYYGNKAVCPCYNNWKTKQGGPKCP

SEQ ID NO: 14448 - protein, 107 aa, Populus trichocarpa
MAKFVAVFLLALIAISMLQTLVVASHGRGGHHNNNKNKYGPGSLKSFQCPSQCTRRCSKTQYHKPCMFFCQKCCKKCLCVPPGYYGNKAVCPCYNNWKTKEGGPKCP

SEQ ID NO: 14449 - protein, 109 aa, Unknown
  Sequence found in Organisms: Castanea mollissima, Quercus alba
MAIAKFVAALLLALIALSMLQTMVMASHGHGGHHYDNTNKFGPGSLKSYQCPSQCTRRCSKTQYHKPCMFFCQKCCKKCLCVPPGYYGNKAVCPCYNNWKTKEGGPKCP

SEQ ID NO: 14450 - protein, 107 aa, Vigna unguiculata
MAKFFAAMILALIAISMLQTVVMAANGHGDHLNDNKSKYGSGSLKSYQCPSQCSRRCSKTQYHKPCMFFCQKCCRKCLCVPPGYYGNKAVCPCYNNWKTKEGGPKCP

SEQ ID NO: 14451 - protein, 107 aa, Lotus japonicus
MPKLLVVLILALIAISMLQTMVMASHGHGGHYYTDKKKYGPGSLKSYQCPSQCTRRCSRTQYHKPCMFFCQKCCRSCLCVPPGYYGNKAVCPCYNNWKTKRGGPKCP

SEQ ID NO: 14452 - protein, 106 aa, Tropaeolum majus
MAKFTAFFLIALIAITMLQTMVMASQGRGGNHSDQKHYGPGSLKGYQCPSQCTRRCSRTQYHKPCMFFCQKCCNKCLCVPPGFYGNKGVCPCYNNWKTKEGGPKCP

SEQ ID NO: 14453 - protein, 106 aa, Fragaria vesca
MVKFVAALLLSLLAISMLQTMVMANHGHGGHHKGNNQYGPGSLKSYQCPSQCTRRCSKTQYHKPCMFFCQKCCSKCLCVPPGFYGNKAVCPCYNNWKTKEGGPKCP

SEQ ID NO: 14454 - protein, 452 aa, Vitis vinifera
MELFPESVTKLWNEWELRALVLLSLFLQIVLILLGNRRKYIASNWVRIIIWLAYLAADWIAAVCIGVLSNENGDDNLSQPNSLIWAFWAPFLLLHLGGPDTITAYSLEDNELWLRHFLALVIQFGGTFYIFLRSWKAKLLNILAIPIFVAGLIKYGERTWVLRSASSEQFRDALLPRPDPGPNYPKFMDEYTSGKAEGYQVSIQQRGKTSRTVHSPPEGDILRQAYYFFETFKGLFADIILSSQRRKRSHGGQVKTKTKTQRATDLCYENDAEKNPDCKACKVLSDYMLYLLVMCPFMLPDGIGEIRYRDSCAEAKEFFKDRKHIKSRTQACKDLLRWELMRGVWVEMLCYAASQCRPNQHAKQLRRGGELLTHVWLLMAHLDVRENFQISQGNAKGGIIDICFRFNSNVNNTYISGNPPPIIGGCIMIDFTLDLLKVLYSYIILLINGSCK

SEQ ID NO: 14455 - protein, 109 aa, Arachis hypogaea
MAKSKFLPVFILALIVISMLQTVVMASHGHGGHHYNDQRKYGPGSLKSYQCPSKCSTRCSRTQYHKPCMFFCQKCCNKCLCVPPGYYGNKAVCPCYNNWKTKEGGPKCP

SEQ ID NO: 14456 - protein, 107 aa, Phaseolus coccineus
MAKFFAAMILALIAISMLQTVVMAANGHGDHLNDNKSKYGSGSVKSYQCPSQCSRRCSRTQYHKPCMFFCQKCCRKCLCVPPGYYGNKAVCPCYNNWKTKEGGPKCP

SEQ ID NO: 14457 - protein, 106 aa, Malus domestica
MAKFFAALFLALLAISMLQTMVLANHGHGGHHKGNNAYGPGSLKSSQCPSECTRRCSQTQYHKPCMFFCQKCCKKCLCVPPGFYGNKAVCPCYNNWKTQQGGPKCP

SEQ ID NO: 14458 - protein, 108 aa, Rosa hybrid cultivar
MATVKFVAALILSLLAISMLQSMVMANHGHGGHHKGNNQYGPGSLKSYQCPSQCTRRCSQTQYHKPCMFFCQKCCSKCLCVPPGYYGNKAVCPCYNNWKTKEGGPKCP

SEQ ID NO: 14459 - protein, 75 aa, Cajanus cajan
MAVPRLLVVLILALIAISMLQTMIMASHGHGGHHYNDKKNLDLAVSGATNALPNARGGAAGPSTTSPACFLPEVL

SEQ ID NO: 14460 - protein, 107 aa, Glycine max
MAKFFAAMILALIAISMLQTVVMAANEQGGHLYDNKSKYGSGSVKRYQCPSQCSRRCSQTQYHKPCMFFCQKCCRKCLCVPPGYYGNKAVCPCYNNWKTKEGGPKCP

SEQ ID NO: 14461 - protein, 108 aa, Actinidia deliciosa
MSITKFSAFLLLALLSISMLQTLVLANHGHGGHHKNRNGYGPGSLKSFQCPSQCSRRCSKTQYHKPCMFFCQKCCNKCLCVPPGFYGNKGVCPCYNNWKTKEGGPKCP

SEQ ID NO: 14462 - protein, 111 aa, Vigna unguiculata
MAVVTAKLLSAFIIALIAISMLQTMVVASHGHGGHHYNDKKKFGPGSLQSSQCPSQCTRRCSRTQYHKPCMFFCQKCCMKCLCVPPGYYGNKAVCPCYNNWKTKRGGPKCP

SEQ ID NO: 14463 - DNA, 666 bp, Artificial Sequence
  Single strand DNA oligonucleotide
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 14464 - DNA, 781 bp, Artificial Sequence
  Single strand DNA oligonucleotide
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 14465 - DNA, 877 bp, Artificial Sequence
  Single strand DNA oligonucleotide
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 14466 - DNA, 2322 bp, Artificial Sequence
  Single strand DNA oligonucleotide
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 14467 - DNA, 2318 bp, Artificial Sequence
  Single strand DNA oligonucleotide
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 14468 - DNA, 1992 bp, Artificial Sequence
  Single strand DNA oligonucleotide
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 14469 - DNA, 1266 bp, Artificial Sequence
  Single strand DNA oligonucleotide
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 14470 - DNA, 2199 bp, Artificial Sequence
  Single strand DNA oligonucleotide
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 14471 - DNA, 1358 bp, Artificial Sequence
  Single strand DNA oligonucleotide
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 14472 - DNA, 1321 bp, Artificial Sequence
  Single strand DNA oligonucleotide
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 14473 - DNA, 1599 bp, Artificial Sequence
  Single strand DNA oligonucleotide
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 14474 - DNA, 1774 bp, Artificial Sequence
  Single strand DNA oligonucleotide
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 14475 - DNA, 1127 bp, Artificial Sequence
  Single strand DNA oligonucleotide
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 14476 - DNA, 916 bp, Artificial Sequence
  Single strand DNA oligonucleotide
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 14477 - DNA, 4089 bp, Artificial Sequence
  Single strand DNA oligonucleotide
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttttctctctccaccaat

SEQ ID NO: 14478 - DNA, 1700 bp, Artificial Sequence
  Single strand DNA oligonucleotide
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 14479 - DNA, 1096 bp, Artificial Sequence
  Single strand DNA oligonucleotide
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 14480 - DNA, 2103 bp, Artificial Sequence
  Single strand DNA oligonucleotide
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 14481 - DNA, 277 bp, Artificial Sequence
  Single strand DNA oligonucleotide
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 14482 - DNA, 31 bp, Artificial Sequence
  Single strand DNA oligonucleotide
aaaggatcccctttgccatttgctgatattc

SEQ ID NO: 14483 - DNA, 33 bp, Artificial Sequence
  Single strand DNA oligonucleotide
aaaggatcctacttgtttagagagagtcccacc

SEQ ID NO: 14484 - DNA, 31 bp, Artificial Sequence
  Single strand DNA oligonucleotide
aaaggatccctttctgtttcttgatcccgag

SEQ ID NO: 14485 - DNA, 31 bp, Artificial Sequence
  Single strand DNA oligonucleotide
aaaggatccaaggcctgtctctctttctttc

SEQ ID NO: 14486 - DNA, 30 bp, Artificial Sequence
  Single strand DNA oligonucleotide
aaagtcgacgcgttcactctctaaccaaac

SEQ ID NO: 14487 - DNA, 28 bp, Artificial Sequence
  Single strand DNA oligonucleotide
aaaggatcctgtcacgtgtcctgacttg

SEQ ID NO: 14488 - DNA, 27 bp, Artificial Sequence
  Single strand DNA oligonucleotide
aaagtcgacgcgatatggcgaaccttc

SEQ ID NO: 14489 - DNA, 31 bp, Artificial Sequence
  Single strand DNA oligonucleotide
aaagtcgaccaaattgcctttactgtgtttc

SEQ ID NO: 14490 - DNA, 36 bp, Artificial Sequence
  Single strand DNA oligonucleotide
aaagtcgacaaaatataactctcaaacaacccaatc

SEQ ID NO: 14491 - DNA, 30 bp, Artificial Sequence
  Single strand DNA oligonucleotide
aaaggatccatttcagacacacaaacccac

SEQ ID NO: 14492 - DNA, 31 bp, Artificial Sequence
  Single strand DNA oligonucleotide
aaagtcgactgtcttgtcctgagatcagatg

SEQ ID NO: 14493 - DNA, 29 bp, Artificial Sequence
  Single strand DNA oligonucleotide
aaagtcgactcgaggcttcgaagaatgtc

SEQ ID NO: 14494 - DNA, 30 bp, Artificial Sequence
  Single strand DNA oligonucleotide
aaaggatcccaatcagagccttgtttcatc

SEQ ID NO: 14495 - DNA, 31 bp, Artificial Sequence
  Single strand DNA oligonucleotide
aaagtcgactagctttggttctttatgcaag

SEQ ID NO: 14496 - DNA, 27 bp, Artificial Sequence
  Single strand DNA oligonucleotide
aaaggatcccgcatctcctccaaatcg

SEQ ID NO: 14497 - DNA, 31 bp, Artificial Sequence
  Single strand DNA oligonucleotide
aaaggatccacaaagtgggctgtaatgatgt

SEQ ID NO: 14498 - DNA, 31 bp, Artificial Sequence
  Single strand DNA oligonucleotide
aaaggatcccttcgtctctaccttccatctc

SEQ ID NO: 14499 - DNA, 31 bp, Artificial Sequence
  Single strand DNA oligonucleotide
aaaggatccttctttatcgtcttcctcaagc

SEQ ID NO: 14500 - DNA, 31 bp, Artificial Sequence
  Single strand DNA oligonucleotide
aaagtcgaccttaagaaaccttccacagtcg

SEQ ID NO: 14501 - DNA, 33 bp, Artificial Sequence
  Single strand DNA oligonucleotide
aaaggatccaactttcctactttgtttcaatcc

SEQ ID NO: 14502 - DNA, 31 bp, Artificial Sequence
  Single strand DNA oligonucleotide
aaaggatccaaaccctagcagcagacacaac

SEQ ID NO: 14503 - DNA, 30 bp, Artificial Sequence
  Single strand DNA oligonucleotide
aaagtcgacaaactcttctctgtttcgacg

SEQ ID NO: 14504 - DNA, 31 bp, Artificial Sequence
  Single strand DNA oligonucleotide
aaagtcgacaaagaagagtgatcgatcggag

SEQ ID NO: 14505 - DNA, 29 bp, Artificial Sequence
  Single strand DNA oligonucleotide
aaaggatccttcctcgagacaccagagac

SEQ ID NO: 14506 - DNA, 31 bp, Artificial Sequence
  Single strand DNA oligonucleotide
aaactcgagaagctgaaatcgaaactcgaac

SEQ ID NO: 14507 - DNA, 31 bp, Artificial Sequence
  Single strand DNA oligonucleotide
aaaggatccgtacgtctccgatgtttcaatc

SEQ ID NO: 14508 - DNA, 34 bp, Artificial Sequence
  Single strand DNA oligonucleotide
aaaggatccgcttgcttggtaatataaagttttg

SEQ ID NO: 14509 - DNA, 33 bp, Artificial Sequence
  Single strand DNA oligonucleotide
aaaggatccaaggaagagaagagtgtccatatc

SEQ ID NO: 14510 - DNA, 31 bp, Artificial Sequence
  Single strand DNA oligonucleotide
aaagtcgacccatcgatttctctcaattagg

SEQ ID NO: 14511 - DNA, 31 bp, Artificial Sequence
  Single strand DNA oligonucleotide
aaaggatcccaaacacctctctttgttggac

SEQ ID NO: 14512 - DNA, 31 bp, Artificial Sequence
  Single strand DNA oligonucleotide
aaaggatcctcatttctctgtttctgattgc

SEQ ID NO: 14513 - DNA, 27 bp, Artificial Sequence
  Single strand DNA oligonucleotide
aaaggatccgtctgtggcgaccaaaag

SEQ ID NO: 14514 - DNA, 31 bp, Artificial Sequence
  Single strand DNA oligonucleotide
aaaggatccactctccaagaaatcgactgag

SEQ ID NO: 14515 - DNA, 29 bp, Artificial Sequence
  Single strand DNA oligonucleotide
aaaggatcccttcaccagtctcttcctcg

SEQ ID NO: 14516 - DNA, 29 bp, Artificial Sequence
  Single strand DNA oligonucleotide
tatggatcctcattcctcacttccaaccg

SEQ ID NO: 14517 - DNA, 31 bp, Artificial Sequence
  Single strand DNA oligonucleotide
aaaggatccttatgattccgattgtgtgaag

SEQ ID NO: 14518 - DNA, 31 bp, Artificial Sequence
  Single strand DNA oligonucleotide
aaaggatccgtcactttcttgtcatccaaac

SEQ ID NO: 14519 - DNA, 31 bp, Artificial Sequence
  Single strand DNA oligonucleotide
aaaggatccacgaagatcctctgtttctgag

SEQ ID NO: 14520 - DNA, 30 bp, Artificial Sequence
  Single strand DNA oligonucleotide
aaaggatccacttacgcatgcatcagcttc

SEQ ID NO: 14521 - DNA, 31 bp, Artificial Sequence
  Single strand DNA oligonucleotide
aaaggatccaagggttggtgaaatatgaatg

SEQ ID NO: 14522 - DNA, 31 bp, Artificial Sequence
  Single strand DNA oligonucleotide
aaaggatccagagagagagaaagatgggttg

SEQ ID NO: 14523 - DNA, 33 bp, Artificial Sequence
  Single strand DNA oligonucleotide
aaagtcgacaagaagaagctctcatcactcatc

SEQ ID NO: 14524 - DNA, 32 bp, Artificial Sequence
  Single strand DNA oligonucleotide
aaaggatccctaagcaaatttcaaagcatttc

SEQ ID NO: 14525 - DNA, 29 bp, Artificial Sequence
  Single strand DNA oligonucleotide
aaaggatcctctctctctctccgacgatg

SEQ ID NO: 14526 - DNA, 29 bp, Artificial Sequence
  Single strand DNA oligonucleotide
aaaggatccgccgagttctctcatttcag

SEQ ID NO: 14527 - DNA, 27 bp, Artificial Sequence
  Single strand DNA oligonucleotide
aaaggatcctccgtcgccttcgtaaag

SEQ ID NO: 14528 - DNA, 31 bp, Artificial Sequence
  Single strand DNA oligonucleotide
aaagtcgacaaataccaaaagaagcggaaac

SEQ ID NO: 14529 - DNA, 33 bp, Artificial Sequence
  Single strand DNA oligonucleotide
aaaggatcccatttatcatcatccttcaagaac

SEQ ID NO: 14530 - DNA, 31 bp, Artificial Sequence
  Single strand DNA oligonucleotide
aaagtcgaccggagtaaaccatttcttcttc

SEQ ID NO: 14531 - DNA, 30 bp, Artificial Sequence
  Single strand DNA oligonucleotide
aaagtcgacgagggtttcttactctgctgc

SEQ ID NO: 14532 - DNA, 31 bp, Artificial Sequence
  Single strand DNA oligonucleotide
aaaggatcccattcacaccagcactcaactc

SEQ ID NO: 14533 - DNA, 31 bp, Artificial Sequence
  Single strand DNA oligonucleotide
aaagtcgactcgacaggaagtagcgaatctc

SEQ ID NO: 14534 - DNA, 31 bp, Artificial Sequence
  Single strand DNA oligonucleotide
aaaggatcctcatcttctctgattcagcgag

SEQ ID NO: 14535 - DNA, 33 bp, Artificial Sequence
  Single strand DNA oligonucleotide
aaaggatccagagaaatggataggagagaagtg

SEQ ID NO: 14536 - DNA, 32 bp, Artificial Sequence
  Single strand DNA oligonucleotide
aaagtcgacattgctttcatgctctgtaactg

SEQ ID NO: 14537 - DNA, 35 bp, Artificial Sequence
  Single strand DNA oligonucleotide
aaagtcgacgatatatggctttcaaggttacactc

SEQ ID NO: 14538 - DNA, 32 bp, Artificial Sequence
  Single strand DNA oligonucleotide
aaagtcgaccgaatattgtgagggagaagaag

SEQ ID NO: 14539 - DNA, 29 bp, Artificial Sequence
  Single strand DNA oligonucleotide
aaagtcgaccaatcatgccctctcacacc

SEQ ID NO: 14540 - DNA, 31 bp, Artificial Sequence
  Single strand DNA oligonucleotide
aaaggatccagaacaatctcgatctcctctc

SEQ ID NO: 14541 - DNA, 30 bp, Artificial Sequence
  Single strand DNA oligonucleotide
aaaggatccggagaatgacaatgaactcgc

SEQ ID NO: 14542 - DNA, 31 bp, Artificial Sequence
  Single strand DNA oligonucleotide
aaaggatccctttccaagtgttctcatcctc

SEQ ID NO: 14543 - DNA, 29 bp, Artificial Sequence
  Single strand DNA oligonucleotide
aaaggatccaaattagcggtgaacagtcg

SEQ ID NO: 14544 - DNA, 31 bp, Artificial Sequence
  Single strand DNA oligonucleotide
aaagtcgactctttcctccctttaatggctc

SEQ ID NO: 14545 - DNA, 28 bp, Artificial Sequence
  Single strand DNA oligonucleotide
aaacccgggcaatcatgtcgaacccagc

SEQ ID NO: 14546 - DNA, 29 bp, Artificial Sequence
  Single strand DNA oligonucleotide
aaaggatcctgttaatggcggaatcatcc

SEQ ID NO: 14547 - DNA, 32 bp, Artificial Sequence
  Single strand DNA oligonucleotide
aaaggatccttgtttctggattattcgctcag

SEQ ID NO: 14548 - DNA, 31 bp, Artificial Sequence
  Single strand DNA oligonucleotide
aaagtcgacatctctatacgcctcctcggat

SEQ ID NO: 14549 - DNA, 31 bp, Artificial Sequence
  Single strand DNA oligonucleotide
aaaggatcccaacacccttttggattcagag

SEQ ID NO: 14550 - DNA, 33 bp, Artificial Sequence
  Single strand DNA oligonucleotide
aaaggatcccagacgaagaaactaattcaaagg

SEQ ID NO: 14551 - DNA, 34 bp, Artificial Sequence
  Single strand DNA oligonucleotide
aaactcgagataagatggaaggaagaaggatcac

SEQ ID NO: 14552 - DNA, 32 bp, Artificial Sequence
  Single strand DNA oligonucleotide
aaaggatccgggactcacaaacacaagaacac

SEQ ID NO: 14553 - DNA, 31 bp, Artificial Sequence
  Single strand DNA oligonucleotide
aaaggatccgatattagggcaatgtgcaagg

SEQ ID NO: 14554 - DNA, 31 bp, Artificial Sequence
  Single strand DNA oligonucleotide
aaagtcgacccacagcctctaaacctctctc

SEQ ID NO: 14555 - DNA, 31 bp, Artificial Sequence
  Single strand DNA oligonucleotide
aaaggatccatctcctcctagcttcttcctc

SEQ ID NO: 14556 - DNA, 31 bp, Artificial Sequence
  Single strand DNA oligonucleotide
aaagtcgacaagttcatagcctcaccgattc

SEQ ID NO: 14557 - DNA, 30 bp, Artificial Sequence
  Single strand DNA oligonucleotide
aaagatatcatgtgtggaggaatcagagag

SEQ ID NO: 14558 - DNA, 28 bp, Artificial Sequence
  Single strand DNA oligonucleotide
aaaggatcccaaacaatggcgttgcttg

SEQ ID NO: 14559 - DNA, 33 bp, Artificial Sequence
  Single strand DNA oligonucleotide
aaaggatcccatagaccaacaacaacaacaatg

SEQ ID NO: 14560 - DNA, 33 bp, Artificial Sequence
  Single strand DNA oligonucleotide
aaagtcgacagtgtcagtttgaaagtgttcttc

SEQ ID NO: 14561 - DNA, 30 bp, Artificial Sequence
  Single strand DNA oligonucleotide
aaagtcgactcagctccattttcattcaag

SEQ ID NO: 14562 - DNA, 31 bp, Artificial Sequence
  Single strand DNA oligonucleotide
aaagtcgacagcattagatagagctcccttg

SEQ ID NO: 14563 - DNA, 31 bp, Artificial Sequence
  Single strand DNA oligonucleotide
aaagtcgacacttccaaatgccaattacgtc

SEQ ID NO: 14564 - DNA, 31 bp, Artificial Sequence
  Single strand DNA oligonucleotide
aaaggatccacatatcgtttggttctccaag

SEQ ID NO: 14565 - DNA, 31 bp, Artificial Sequence
  Single strand DNA oligonucleotide
aaagtcgacaaaaaatgacagcagagacagc

SEQ ID NO: 14566 - DNA, 29 bp, Artificial Sequence
  Single strand DNA oligonucleotide
aaaggatccaccctaaccctagccacatc

SEQ ID NO: 14567 - DNA, 26 bp, Artificial Sequence
  Single strand DNA oligonucleotide
aaagaattcccaggatggtggcgatc

SEQ ID NO: 14568 - DNA, 31 bp, Artificial Sequence
  Single strand DNA oligonucleotide
aaaggatcctggactgtggagagtttctgtc

SEQ ID NO: 14569 - DNA, 33 bp, Artificial Sequence
  Single strand DNA oligonucleotide
aaagtcgacgctatccctaattcatgaacaaaa

SEQ ID NO: 14570 - DNA, 33 bp, Artificial Sequence
  Single strand DNA oligonucleotide
aaaggatccttgatgagcttccactatttacag

SEQ ID NO: 14571 - DNA, 31 bp, Artificial Sequence
  Single strand DNA oligonucleotide
aaaggatccagtcagacttcacacagcaaag

SEQ ID NO: 14572 - DNA, 31 bp, Artificial Sequence
  Single strand DNA oligonucleotide
aaactcgagacggcaacacatgtaacataac

SEQ ID NO: 14573 - DNA, 27 bp, Artificial Sequence
  Single strand DNA oligonucleotide
aaaggatccccaaaatggccacaacac

SEQ ID NO: 14574 - DNA, 36 bp, Artificial Sequence
  Single strand DNA oligonucleotide
aaaggatccgctactgttacacctagagagagaaag

SEQ ID NO: 14575 - DNA, 31 bp, Artificial Sequence
  Single strand DNA oligonucleotide
aaactcgagctgttacaccttcacctccatc

SEQ ID NO: 14576 - DNA, 30 bp, Artificial Sequence
  Single strand DNA oligonucleotide
aaaggatccctgcattatctccttcccttc

SEQ ID NO: 14577 - DNA, 31 bp, Artificial Sequence
  Single strand DNA oligonucleotide
aaagtcgaccgtttcaacagtcatcatcttc

SEQ ID NO: 14578 - DNA, 27 bp, Artificial Sequence
  Single strand DNA oligonucleotide
aaagtcgactggtgaaatggcagctac

SEQ ID NO: 14579 - DNA, 36 bp, Artificial Sequence
  Single strand DNA oligonucleotide
aaaggatccaataaaccacttttctttctaagtctg

SEQ ID NO: 14580 - DNA, 31 bp, Artificial Sequence
  Single strand DNA oligonucleotide
aaaggatccgttcacacatctctcaaacctc

SEQ ID NO: 14581 - DNA, 31 bp, Artificial Sequence
  Single strand DNA oligonucleotide
aaagtcgacacttcacactctttggccttac

SEQ ID NO: 14582 - DNA, 28 bp, Artificial Sequence
  Single strand DNA oligonucleotide
aaaggatccctgtgtgaggaaaggcaag

SEQ ID NO: 14583 - DNA, 35 bp, Artificial Sequence
  Single strand DNA oligonucleotide
aaagtcgaccattgtaaacaaagaagcacaaaatg

SEQ ID NO: 14584 - DNA, 35 bp, Artificial Sequence
  Single strand DNA oligonucleotide
aaagtcgactaactaacacacattcctcacatatc

SEQ ID NO: 14585 - DNA, 31 bp, Artificial Sequence
  Single strand DNA oligonucleotide
aaagtcgactgcactcttgttctttaaggtg

SEQ ID NO: 14586 - DNA, 37 bp, Artificial Sequence
  Single strand DNA oligonucleotide
aaaggatccaaggaatgctgagatttataacatcatc

SEQ ID NO: 14587 - DNA, 27 bp, Artificial Sequence
  Single strand DNA oligonucleotide
aaaggatccgagagagggaaagcgttg

SEQ ID NO: 14588 - DNA, 30 bp, Artificial Sequence
  Single strand DNA oligonucleotide
aaaggatcccatagcacacctggtgacaac

SEQ ID NO: 14589 - DNA, 27 bp, Artificial Sequence
  Single strand DNA oligonucleotide
aaaggatcccacctttcaacgccattc

SEQ ID NO: 14590 - DNA, 29 bp, Artificial Sequence
  Single strand DNA oligonucleotide
aaaggatccgaagtgggaacagttggtgg

SEQ ID NO: 14591 - DNA, 30 bp, Artificial Sequence
  Single strand DNA oligonucleotide
aaaggatcccagttgagttgctctcacacg

SEQ ID NO: 14592 - DNA, 28 bp, Artificial Sequence
  Single strand DNA oligonucleotide
aaactcgaggaggcttcatctcgtgtcg

SEQ ID NO: 14593 - DNA, 29 bp, Artificial Sequence
  Single strand DNA oligonucleotide
aaaggatccgatcgaagaggagtgcatcg

SEQ ID NO: 14594 - DNA, 30 bp, Artificial Sequence
  Single strand DNA oligonucleotide
aaaggatccctcctttcgccgattaacatc

SEQ ID NO: 14595 - DNA, 29 bp, Artificial Sequence
  Single strand DNA oligonucleotide
aaaggatccagtctccgaagaggcgagag

SEQ ID NO: 14596 - DNA, 31 bp, Artificial Sequence
  Single strand DNA oligonucleotide
aaaggatcctggagacggagaaagtgaagtc

SEQ ID NO: 14597 - DNA, 31 bp, Artificial Sequence
  Single strand DNA oligonucleotide
aaagtcgacattagaatctccgtccgacacc

SEQ ID NO: 14598 - DNA, 28 bp, Artificial Sequence
  Single strand DNA oligonucleotide
aaactcgagccaaatctcccatggcttc

SEQ ID NO: 14599 - DNA, 30 bp, Artificial Sequence
  Single strand DNA oligonucleotide
aaaggatccactgcagaagcttcccaaatc

SEQ ID NO: 14600 - DNA, 27 bp, Artificial Sequence
  Single strand DNA oligonucleotide
aaaggatccggtagagcccgatccgac

SEQ ID NO: 14601 - DNA, 31 bp, Artificial Sequence
  Single strand DNA oligonucleotide
aaaggatccttaattggtctcctcaaactcc

SEQ ID NO: 14602 - DNA, 31 bp, Artificial Sequence
  Single strand DNA oligonucleotide
aaagtcgactatgcgaattaaatgaagcaag

SEQ ID NO: 14603 - DNA, 31 bp, Artificial Sequence
  Single strand DNA oligonucleotide
aaagtcgacaactacactgttccatcattgc

SEQ ID NO: 14604 - DNA, 35 bp, Artificial Sequence
  Single strand DNA oligonucleotide
aaaggatccaactagaaaggagaataaagaaatgg

SEQ ID NO: 14605 - DNA, 30 bp, Artificial Sequence
  Single strand DNA oligonucleotide
aaaggatccctccttcaaccacgctagttc

SEQ ID NO: 14606 - DNA, 31 bp, Artificial Sequence
  Single strand DNA oligonucleotide
aaagtcgaccatctgtgagagtggctcatac

SEQ ID NO: 14607 - DNA, 29 bp, Artificial Sequence
  Single strand DNA oligonucleotide
aaagtcgaccaaggtaacgaacgtagctg

SEQ ID NO: 14608 - DNA, 36 bp, Artificial Sequence
  Single strand DNA oligonucleotide
aaaggatccttattatggtgactatggaagagagtc

SEQ ID NO: 14609 - DNA, 30 bp, Artificial Sequence
  Single strand DNA oligonucleotide
aaagtcgacagatattgaaagggctcttgg

SEQ ID NO: 14610 - DNA, 32 bp, Artificial Sequence
  Single strand DNA oligonucleotide
aaagtcgaccggaggcatatcatccttatatc

SEQ ID NO: 14611 - DNA, 33 bp, Artificial Sequence
  Single strand DNA oligonucleotide
aaagtcgacaagtttgattctgtttccagtttc

SEQ ID NO: 14612 - DNA, 31 bp, Artificial Sequence
  Single strand DNA oligonucleotide
aaaggatcctcctgctaaagacagatctcag

SEQ ID NO: 14613 - DNA, 29 bp, Artificial Sequence
  Single strand DNA oligonucleotide
aaaggatcccttgtggataggacgcaatc

SEQ ID NO: 14614 - DNA, 31 bp, Artificial Sequence
  Single strand DNA oligonucleotide
aaagtcgactgcaggttatctttcatctcag

SEQ ID NO: 14615 - DNA, 30 bp, Artificial Sequence
  Single strand DNA oligonucleotide
aaaggatccgttctgttctgtacctgcacc

SEQ ID NO: 14616 - DNA, 31 bp, Artificial Sequence
  Single strand DNA oligonucleotide
aaaggatccggttggtgtgtaggaagcagag

SEQ ID NO: 14617 - DNA, 29 bp, Artificial Sequence
  Single strand DNA oligonucleotide
aaagtcgacaaagggagtgcctgataacc

SEQ ID NO: 14618 - DNA, 31 bp, Artificial Sequence
  Single strand DNA oligonucleotide
aaactcgagactagtgcggttgtgtgttctg

SEQ ID NO: 14619 - DNA, 33 bp, Artificial Sequence
  Single strand DNA oligonucleotide
aaaggatcccacgataagtgacaacattagacg

SEQ ID NO: 14620 - DNA, 31 bp, Artificial Sequence
  Single strand DNA oligonucleotide
aaagtcgacctcctaggtggaattggaattg

SEQ ID NO: 14621 - DNA, 31 bp, Artificial Sequence
  Single strand DNA oligonucleotide
aaaggatccgttgttgtgctggttctctatg

SEQ ID NO: 14622 - DNA, 31 bp, Artificial Sequence
  Single strand DNA oligonucleotide
aaaggatcctgaaaatggtaaccatccactg

SEQ ID NO: 14623 - DNA, 31 bp, Artificial Sequence
  Single strand DNA oligonucleotide
aaagtcgacaacacactctgctgatgacaag

SEQ ID NO: 14624 - DNA, 31 bp, Artificial Sequence
  Single strand DNA oligonucleotide
aaagtcgacctcttctcctaggtttcactcc

SEQ ID NO: 14625 - DNA, 33 bp, Artificial Sequence
  Single strand DNA oligonucleotide
aaaggatccaacagagtaatggtggtgaagatg

SEQ ID NO: 14626 - DNA, 28 bp, Artificial Sequence
  Single strand DNA oligonucleotide
aaaggatcccgatcgatattcgacaagc

SEQ ID NO: 14627 - DNA, 36 bp, Artificial Sequence
  Single strand DNA oligonucleotide
aaagtcgaccaataactagaaatctagaatggcttt

SEQ ID NO: 14628 - DNA, 28 bp, Artificial Sequence
  Single strand DNA oligonucleotide
aaaggatccgtaacagcaggtttgggag

SEQ ID NO: 14629 - DNA, 36 bp, Artificial Sequence
  Single strand DNA oligonucleotide
aaaggatccctctctacactctattcaacccttcac

SEQ ID NO: 14630 - DNA, 31 bp, Artificial Sequence
  Single strand DNA oligonucleotide
aaaggatccgatttcgacacaacaactttcc

SEQ ID NO: 14631 - DNA, 31 bp, Artificial Sequence
  Single strand DNA oligonucleotide
aaagtcgacttgtacaacaccacggatagac

SEQ ID NO: 14632 - DNA, 31 bp, Artificial Sequence
  Single strand DNA oligonucleotide
aaaggatccgcatgagcaatttgtgtttaag

SEQ ID NO: 14633 - DNA, 31 bp, Artificial Sequence
  Single strand DNA oligonucleotide
aaagtcgacaatttccctaccgctgataaac

SEQ ID NO: 14634 - DNA, 36 bp, Artificial Sequence
  Single strand DNA oligonucleotide
aaagtcgacatacacctcctctatcacacatttcac

SEQ ID NO: 14635 - DNA, 31 bp, Artificial Sequence
  Single strand DNA oligonucleotide
aaactcgaggtttgttcaagtgtgctattgg

SEQ ID NO: 14636 - DNA, 29 bp, Artificial Sequence
  Single strand DNA oligonucleotide
aaagtcgacggcacaaaccagaagagttg

SEQ ID NO: 14637 - DNA, 33 bp, Artificial Sequence
  Single strand DNA oligonucleotide
aaactcgagtgtgttattacaagccaaaaactg

SEQ ID NO: 14638 - DNA, 28 bp, Artificial Sequence
  Single strand DNA oligonucleotide
aaagtcgaccattccacgttcttcgctc

SEQ ID NO: 14639 - DNA, 32 bp, Artificial Sequence
  Single strand DNA oligonucleotide
aaagtcgacctgtattcatttgattgatttgg

SEQ ID NO: 14640 - DNA, 32 bp, Artificial Sequence
  Single strand DNA oligonucleotide
aaagtcgactgaaactcgaaaccctatgttac

SEQ ID NO: 14641 - DNA, 28 bp, Artificial Sequence
  Single strand DNA oligonucleotide
aaaggatccgtgattctccaaccaccac

SEQ ID NO: 14642 - DNA, 31 bp, Artificial Sequence
  Single strand DNA oligonucleotide
aaagtcgactattcagctgtcaacgatttgc

SEQ ID NO: 14643 - DNA, 32 bp, Artificial Sequence
  Single strand DNA oligonucleotide
aaaggatcccaaatctttgatggatgattctc

SEQ ID NO: 14644 - DNA, 31 bp, Artificial Sequence
  Single strand DNA oligonucleotide
aaaggatccatcacttccgaggcagtttatc

SEQ ID NO: 14645 - DNA, 33 bp, Artificial Sequence
  Single strand DNA oligonucleotide
aaaggatccaatcttcgtctcctcctagctctc

SEQ ID NO: 14646 - DNA, 31 bp, Artificial Sequence
  Single strand DNA oligonucleotide
aaaggatcctcgaagtgtggtttcttcatag

SEQ ID NO: 14647 - DNA, 30 bp, Artificial Sequence
  Single strand DNA oligonucleotide
aaaggatccaaagatgtcattagcttcgcc

SEQ ID NO: 14648 - DNA, 32 bp, Artificial Sequence
  Single strand DNA oligonucleotide
aaagaattctgaagatatggcaactttgaacc

SEQ ID NO: 14649 - DNA, 32 bp, Artificial Sequence
  Single strand DNA oligonucleotide
aaaggatccggacaatcaatcatacacagacg

SEQ ID NO: 14650 - DNA, 33 bp, Artificial Sequence
  Single strand DNA oligonucleotide
aaagtcgaccataccctcttccttcattacatc

SEQ ID NO: 14651 - DNA, 28 bp, Artificial Sequence
  Single strand DNA oligonucleotide
aaagtcgaccaatttgaggccattgcac

SEQ ID NO: 14652 - DNA, 35 bp, Artificial Sequence
  Single strand DNA oligonucleotide
aaaggatcccaagctaattaactatcactccaatg

SEQ ID NO: 14653 - DNA, 36 bp, Artificial Sequence
  Single strand DNA oligonucleotide
aaaggatccttaggaaaataaatcaattatggctac

SEQ ID NO: 14654 - DNA, 31 bp, Artificial Sequence
  Single strand DNA oligonucleotide
aaaggatcctccgctagggttagggttttac

SEQ ID NO: 14655 - DNA, 31 bp, Artificial Sequence
  Single strand DNA oligonucleotide
aaaggatccaaacagatcgactccacaaagc

SEQ ID NO: 14656 - DNA, 29 bp, Artificial Sequence
  Single strand DNA oligonucleotide
aaagatatcgtcgtcgcactcacactagc

SEQ ID NO: 14657 - DNA, 28 bp, Artificial Sequence
  Single strand DNA oligonucleotide
aaaggatccgcgttggacagggagctag

SEQ ID NO: 14658 - DNA, 27 bp, Artificial Sequence
  Single strand DNA oligonucleotide
aaaggatccttagccggcaaagagtgg

SEQ ID NO: 14659 - DNA, 31 bp, Artificial Sequence
  Single strand DNA oligonucleotide
aaaggatccattctcagcttcttcagcgttc

SEQ ID NO: 14660 - DNA, 30 bp, Artificial Sequence
  Single strand DNA oligonucleotide
aaagtcgacctggtctcgtgcaagtgtaac

SEQ ID NO: 14661 - DNA, 27 bp, Artificial Sequence
  Single strand DNA oligonucleotide
aaaggatccctgcatcttcacgtcgtc

SEQ ID NO: 14662 - DNA, 30 bp, Artificial Sequence
  Single strand DNA oligonucleotide
aaaggatccgcacccaataccctcaaactc

SEQ ID NO: 14663 - DNA, 31 bp, Artificial Sequence
  Single strand DNA oligonucleotide
aaaggatcctcgcaaataaatcaatctcaag

SEQ ID NO: 14664 - DNA, 31 bp, Artificial Sequence
  Single strand DNA oligonucleotide
aaagtcgacgcccattgtgaagtatttgttc

SEQ ID NO: 14665 - DNA, 28 bp, Artificial Sequence
  Single strand DNA oligonucleotide
aaaggatccatattgtgcggcaagtgtc

SEQ ID NO: 14666 - DNA, 30 bp, Artificial Sequence
  Single strand DNA oligonucleotide
aaaggatccaactctgcaccatccattcac

SEQ ID NO: 14667 - DNA, 29 bp, Artificial Sequence
  Single strand DNA oligonucleotide
aaagtcgaccttgtcagcatcgcagttac

SEQ ID NO: 14668 - DNA, 31 bp, Artificial Sequence
  Single strand DNA oligonucleotide
aaaggatccgaagaagatgggtttgaagaac

SEQ ID NO: 14669 - DNA, 33 bp, Artificial Sequence
  Single strand DNA oligonucleotide
aaaggatccttgttgctctctctctcttctcac

SEQ ID NO: 14670 - DNA, 31 bp, Artificial Sequence
  Single strand DNA oligonucleotide
aaaggtacctccaacattcctagtcacatgc

SEQ ID NO: 14671 - DNA, 31 bp, Artificial Sequence
  Single strand DNA oligonucleotide
aaaggtaccatcaacctcgacttcttacctg

SEQ ID NO: 14672 - DNA, 39 bp, Artificial Sequence
  Single strand DNA oligonucleotide
aaaggtaccctattgcgagagcagtatattatttgattc

SEQ ID NO: 14673 - DNA, 32 bp, Artificial Sequence
  Single strand DNA oligonucleotide
aaaggtaccggacttatattaaacgcgagagc

SEQ ID NO: 14674 - DNA, 31 bp, Artificial Sequence
  Single strand DNA oligonucleotide
aaaaggcctttgagaaagaagccacaactac

SEQ ID NO: 14675 - DNA, 30 bp, Artificial Sequence
  Single strand DNA oligonucleotide
aaaggtacccaaagaaacaatgagggtgac

SEQ ID NO: 14676 - DNA, 35 bp, Artificial Sequence
  Single strand DNA oligonucleotide
tttaggccttcaaatttatttctgtcctttacgag

SEQ ID NO: 14677 - DNA, 31 bp, Artificial Sequence
  Single strand DNA oligonucleotide
aaagagctccttacacattcagaccaaatcg

SEQ ID NO: 14678 - DNA, 31 bp, Artificial Sequence
  Single strand DNA oligonucleotide
aaaggatcccgtgatccacacattaattacg

SEQ ID NO: 14679 - DNA, 31 bp, Artificial Sequence
  Single strand DNA oligonucleotide
aaaggtacccaaatcgaacaagaaagaaacc

SEQ ID NO: 14680 - DNA, 31 bp, Artificial Sequence
  Single strand DNA oligonucleotide
aaagatatcggaaagcctctatctgcttatg

SEQ ID NO: 14681 - DNA, 35 bp, Artificial Sequence
  Single strand DNA oligonucleotide
aaaggatccagttacattattgatgagaccattgc

SEQ ID NO: 14682 - DNA, 31 bp, Artificial Sequence
  Single strand DNA oligonucleotide
aaaggtacccaacggtaataacaacaaatgc

SEQ ID NO: 14683 - DNA, 31 bp, Artificial Sequence
  Single strand DNA oligonucleotide
aaaaggccttcttcttctgtgcttcaaagtg

SEQ ID NO: 14684 - DNA, 32 bp, Artificial Sequence
  Single strand DNA oligonucleotide
aaaggtaccaaccacacaagtctttcttgtcc

SEQ ID NO: 14685 - DNA, 30 bp, Artificial Sequence
  Single strand DNA oligonucleotide
aaaggtaccctacccattttgtgccctatc

SEQ ID NO: 14686 - DNA, 31 bp, Artificial Sequence
  Single strand DNA oligonucleotide
aaaggtaccaacaatgaaggaagaagattgc

SEQ ID NO: 14687 - DNA, 31 bp, Artificial Sequence
  Single strand DNA oligonucleotide
aaaggtacccgaaactcaacatgaatcacac

SEQ ID NO: 14688 - DNA, 31 bp, Artificial Sequence
  Single strand DNA oligonucleotide
aaagaattcactttagagggatttggtttcc

SEQ ID NO: 14689 - DNA, 32 bp, Artificial Sequence
  Single strand DNA oligonucleotide
aaaggtaccggtgggtttgatgaaccttatac

SEQ ID NO: 14690 - DNA, 33 bp, Artificial Sequence
  Single strand DNA oligonucleotide
aaaggtacctcaccacgaatatttaaattcagc

SEQ ID NO: 14691 - DNA, 31 bp, Artificial Sequence
  Single strand DNA oligonucleotide
aaaggatccgttgtgcgatactcaaagaaag

SEQ ID NO: 14692 - DNA, 31 bp, Artificial Sequence
  Single strand DNA oligonucleotide
aaagaattccagtaaatctctcaaccggctc

SEQ ID NO: 14693 - DNA, 32 bp, Artificial Sequence
  Single strand DNA oligonucleotide
aaaggtacccaaggattagacaaccaaatgag

SEQ ID NO: 14694 - DNA, 31 bp, Artificial Sequence
  Single strand DNA oligonucleotide
aaagaattcggacctgggtagagacaatcag

SEQ ID NO: 14695 - DNA, 31 bp, Artificial Sequence
  Single strand DNA oligonucleotide
aaaggtaccttaagactctgcatcctgacac

SEQ ID NO: 14696 - DNA, 31 bp, Artificial Sequence
  Single strand DNA oligonucleotide
tttggtaccttattaagcagcccatggtatg

SEQ ID NO: 14697 - DNA, 31 bp, Artificial Sequence
  Single strand DNA oligonucleotide
aaaggtacctatagtcaacgaatttcccgag

SEQ ID NO: 14698 - DNA, 33 bp, Artificial Sequence
  Single strand DNA oligonucleotide
aaagaattctcaaatagaaacccttcatctttc

SEQ ID NO: 14699 - DNA, 31 bp, Artificial Sequence
  Single strand DNA oligonucleotide
aaaggtaccaaagctatgagccaacagattc

SEQ ID NO: 14700 - DNA, 31 bp, Artificial Sequence
  Single strand DNA oligonucleotide
aaaggtaccattggacattgatttagcgaac

SEQ ID NO: 14701 - DNA, 34 bp, Artificial Sequence
  Single strand DNA oligonucleotide
aaaggtaccctacagaagagtgttttgattctgg

SEQ ID NO: 14702 - DNA, 31 bp, Artificial Sequence
  Single strand DNA oligonucleotide
aaaggtaccgaccaaagttgttgagttgttc

SEQ ID NO: 14703 - DNA, 31 bp, Artificial Sequence
  Single strand DNA oligonucleotide
aaaggtaccatggccgttcatgttattctac

SEQ ID NO: 14704 - DNA, 31 bp, Artificial Sequence
  Single strand DNA oligonucleotide
aaaggtaccaaccgccaatttcttccataac

SEQ ID NO: 14705 - DNA, 32 bp, Artificial Sequence
  Single strand DNA oligonucleotide
aaaggtaccccaggagacacatccaaatatag

SEQ ID NO: 14706 - DNA, 32 bp, Artificial Sequence
  Single strand DNA oligonucleotide
aaaggtaccccgacatttgacatggtatttag

SEQ ID NO: 14707 - DNA, 32 bp, Artificial Sequence
  Single strand DNA oligonucleotide
aaaggtaccccaatctacagatgtccaaattc

SEQ ID NO: 14708 - DNA, 32 bp, Artificial Sequence
  Single strand DNA oligonucleotide
aaaggtacctcctctgccattaaacttagacg

SEQ ID NO: 14709 - DNA, 32 bp, Artificial Sequence
  Single strand DNA oligonucleotide
aaaggtaccttaccaataaataccagctttcc

SEQ ID NO: 14710 - DNA, 31 bp, Artificial Sequence
  Single strand DNA oligonucleotide
aaaggtaccacacaccaagagcactaaacac

SEQ ID NO: 14711 - DNA, 31 bp, Artificial Sequence
  Single strand DNA oligonucleotide
aaagaattcttgtcccacacatttgatctac

SEQ ID NO: 14712 - DNA, 34 bp, Artificial Sequence
  Single strand DNA oligonucleotide
aaaggtacccatatcgcataactaagaaatcgtc

SEQ ID NO: 14713 - DNA, 31 bp, Artificial Sequence
  Single strand DNA oligonucleotide
aaaggtaccgagtataaagggcaacttcagc

SEQ ID NO: 14714 - DNA, 34 bp, Artificial Sequence
  Single strand DNA oligonucleotide
aaaggtaccctaacaaaggaacttcggagttatg

SEQ ID NO: 14715 - DNA, 31 bp, Artificial Sequence
  Single strand DNA oligonucleotide
aaaggtacccatcttcctccatcaatgtcag

SEQ ID NO: 14716 - DNA, 31 bp, Artificial Sequence
  Single strand DNA oligonucleotide
aaagaattcacccttacagattagagcttgg

SEQ ID NO: 14717 - DNA, 32 bp, Artificial Sequence
  Single strand DNA oligonucleotide
aaaggtacccctcaaacctaaatatcacatgg

SEQ ID NO: 14718 - DNA, 31 bp, Artificial Sequence
  Single strand DNA oligonucleotide
aaagaattcttaacaacatttccaatccctc

SEQ ID NO: 14719 - DNA, 28 bp, Artificial Sequence
  Single strand DNA oligonucleotide
aaagaattcgttcggttccatgtttgag

SEQ ID NO: 14720 - DNA, 32 bp, Artificial Sequence
  Single strand DNA oligonucleotide
aaaggtaccttaagcaccagattgacaacaac

SEQ ID NO: 14721 - DNA, 33 bp, Artificial Sequence
  Single strand DNA oligonucleotide
aaagaattcctagcccttcggatacaacaagac

SEQ ID NO: 14722 - DNA, 35 bp, Artificial Sequence
  Single strand DNA oligonucleotide
tttggtaccctatgtctacagtgtctggaagaacc

SEQ ID NO: 14723 - DNA, 34 bp, Artificial Sequence
  Single strand DNA oligonucleotide
tttgaattcaaggaaaaagcaagattactaggag

SEQ ID NO: 14724 - DNA, 31 bp, Artificial Sequence
  Single strand DNA oligonucleotide
aaagaattctgttaccctccagaatccatag

SEQ ID NO: 14725 - DNA, 34 bp, Artificial Sequence
  Single strand DNA oligonucleotide
tttgaattcttattatgttatgacggtgggagct

SEQ ID NO: 14726 - DNA, 31 bp, Artificial Sequence
  Single strand DNA oligonucleotide
aaagaattcattaactacacccattcggagc

SEQ ID NO: 14727 - DNA, 34 bp, Artificial Sequence
  Single strand DNA oligonucleotide
tttgaattcttattactcgagatgatcatgcggt

SEQ ID NO: 14728 - DNA, 34 bp, Artificial Sequence
  Single strand DNA oligonucleotide
aaaggtaccttctccaccttcatctattagtgtc

SEQ ID NO: 14729 - DNA, 34 bp, Artificial Sequence
  Single strand DNA oligonucleotide
tttggtacctcatcaatcatcagctccatcagtc

SEQ ID NO: 14730 - DNA, 36 bp, Artificial Sequence
  Single strand DNA oligonucleotide
aaaggtacctgataatacagagtcaaacgttacaag

SEQ ID NO: 14731 - DNA, 34 bp, Artificial Sequence
  Single strand DNA oligonucleotide
aaaaggcctctatatgaccagaatccgaacaaac

SEQ ID NO: 14732 - DNA, 31 bp, Artificial Sequence
  Single strand DNA oligonucleotide
aaaggatccctcgatctcaatcacacacacc

SEQ ID NO: 14733 - DNA, 36 bp, Artificial Sequence
  Single strand DNA oligonucleotide
tttggtacctcactaattgtagagatcatcatcgtc

SEQ ID NO: 14734 - DNA, 32 bp, Artificial Sequence
  Single strand DNA oligonucleotide
tttggtaccttagagagagaggccttgtcgac

SEQ ID NO: 14735 - DNA, 32 bp, Artificial Sequence
  Single strand DNA oligonucleotide
aaaggtaccttctcagaatacacatgccaaac

SEQ ID NO: 14736 - DNA, 36 bp, Artificial Sequence
  Single strand DNA oligonucleotide
tttgaattcctactaacagtgggatctagcatgctc

SEQ ID NO: 14737 - DNA, 36 bp, Artificial Sequence
  Single strand DNA oligonucleotide
aaaggtacctcaaaacatcaaaggttacatcaaatc

SEQ ID NO: 14738 - DNA, 32 bp, Artificial Sequence
  Single strand DNA oligonucleotide
aaaggtaccccttcaagacaacgtaaagaaac

SEQ ID NO: 14739 - DNA, 33 bp, Artificial Sequence
  Single strand DNA oligonucleotide
aaagaattctcatcaattggaccacacatgaac

SEQ ID NO: 14740 - DNA, 33 bp, Artificial Sequence
  Single strand DNA oligonucleotide
aaaggtaccaattaacatcctcaaacgcatacc

SEQ ID NO: 14741 - DNA, 31 bp, Artificial Sequence
  Single strand DNA oligonucleotide
aaaggtaccccaacgataaaccaaacaaagc

SEQ ID NO: 14742 - DNA, 31 bp, Artificial Sequence
  Single strand DNA oligonucleotide
aaagatatcaccattacaagtggctctgttg

SEQ ID NO: 14743 - DNA, 34 bp, Artificial Sequence
  Single strand DNA oligonucleotide
aaaggtaccctacttcatcaacttgttggttagc

SEQ ID NO: 14744 - DNA, 32 bp, Artificial Sequence
  Single strand DNA oligonucleotide
aaaaggcctgtcacggtcatatagggatcaac

SEQ ID NO: 14745 - DNA, 31 bp, Artificial Sequence
  Single strand DNA oligonucleotide
aaactcgagctagcaatgcagagagatgttg

SEQ ID NO: 14746 - DNA, 31 bp, Artificial Sequence
  Single strand DNA oligonucleotide
aaaggtacccctttaaaccacacgaagaacg

SEQ ID NO: 14747 - DNA, 36 bp, Artificial Sequence
  Single strand DNA oligonucleotide
tttggtaccttattatatccacagagaagaagcagc

SEQ ID NO: 14748 - DNA, 35 bp, Artificial Sequence
  Single strand DNA oligonucleotide
aaaggatccctatttcggatattcgtatttcaaag

SEQ ID NO: 14749 - DNA, 31 bp, Artificial Sequence
  Single strand DNA oligonucleotide
aaaggatccggcttcactctaaattgctttg

SEQ ID NO: 14750 - DNA, 32 bp, Artificial Sequence
  Single strand DNA oligonucleotide
aaagaattcttccgtacatcatagaacacttg

SEQ ID NO: 14751 - DNA, 31 bp, Artificial Sequence
  Single strand DNA oligonucleotide
aaagaattctctttcttccagctgagttgtg

SEQ ID NO: 14752 - DNA, 31 bp, Artificial Sequence
  Single strand DNA oligonucleotide
aaaggtacctccatagttcacaacaacttcg

SEQ ID NO: 14753 - DNA, 33 bp, Artificial Sequence
  Single strand DNA oligonucleotide
tttgaattctcatcaagcaacaacttcttgttg

SEQ ID NO: 14754 - DNA, 31 bp, Artificial Sequence
  Single strand DNA oligonucleotide
tttggtacctcagacgagacagcttgtccag

SEQ ID NO: 14755 - DNA, 37 bp, Artificial Sequence
  Single strand DNA oligonucleotide
tttaggccttcatcaagatgttaagatcgcagacttg

SEQ ID NO: 14756 - DNA, 31 bp, Artificial Sequence
  Single strand DNA oligonucleotide
aaaggtacccagtatatgctccttgctgctg

SEQ ID NO: 14757 - DNA, 31 bp, Artificial Sequence
  Single strand DNA oligonucleotide
aaagagctcctctatttccggtgacactctt

SEQ ID NO: 14758 - DNA, 36 bp, Artificial Sequence
  Single strand DNA oligonucleotide
aaaggtaccttctaatagaccggtttagtgacttag

SEQ ID NO: 14759 - DNA, 29 bp, Artificial Sequence
  Single strand DNA oligonucleotide
aaaggtacccctgccttagtttgttctcg

SEQ ID NO: 14760 - DNA, 35 bp, Artificial Sequence
  Single strand DNA oligonucleotide
aaagaattcgcagaatttatttcagtactcactcc

SEQ ID NO: 14761 - DNA, 35 bp, Artificial Sequence
  Single strand DNA oligonucleotide
tttggtacctcatcaaacttttggaggtgtgttag

SEQ ID NO: 14762 - DNA, 31 bp, Artificial Sequence
  Single strand DNA oligonucleotide
aaaggtaccagggttgtttgtcaagagattc

SEQ ID NO: 14763 - DNA, 31 bp, Artificial Sequence
  Single strand DNA oligonucleotide
aaagaattcacagaatatttatccacgggac

SEQ ID NO: 14764 - DNA, 31 bp, Artificial Sequence
  Single strand DNA oligonucleotide
aaaggtaccccggctgacaagtagaaataag

SEQ ID NO: 14765 - DNA, 34 bp, Artificial Sequence
  Single strand DNA oligonucleotide
aaagaattcaacctacaaactctattaaggctcc

SEQ ID NO: 14766 - DNA, 28 bp, Artificial Sequence
  Single strand DNA oligonucleotide
tttgaattctgcaaccaagaactccaac

SEQ ID NO: 14767 - DNA, 31 bp, Artificial Sequence
  Single strand DNA oligonucleotide
aaaggtaccttcatgtgctttcaaaattgtc

SEQ ID NO: 14768 - DNA, 31 bp, Artificial Sequence
  Single strand DNA oligonucleotide
aaaggtaccaacaccgataagaacgagaatc

SEQ ID NO: 14769 - DNA, 32 bp, Artificial Sequence
  Single strand DNA oligonucleotide
aaagaattctcagctttagttaccacttcgtc

SEQ ID NO: 14770 - DNA, 31 bp, Artificial Sequence
  Single strand DNA oligonucleotide
aaaggtaccgtacattcctttaacctgctgc

SEQ ID NO: 14771 - DNA, 32 bp, Artificial Sequence
  Single strand DNA oligonucleotide
ttgatatcttactgttgtgcctttcactctgc

SEQ ID NO: 14772 - DNA, 30 bp, Artificial Sequence
  Single strand DNA oligonucleotide
aaaggatcccgatcggtacccaaatctatc

SEQ ID NO: 14773 - DNA, 31 bp, Artificial Sequence
  Single strand DNA oligonucleotide
aaaggatccgattcacagaaatcccaatcag

SEQ ID NO: 14774 - DNA, 37 bp, Artificial Sequence
  Single strand DNA oligonucleotide
tttggtaccctactagctggacaagtactgtgtcatc

SEQ ID NO: 14775 - DNA, 31 bp, Artificial Sequence
  Single strand DNA oligonucleotide
aaaggtaccatcgcttgagatcagtttcatc

SEQ ID NO: 14776 - DNA, 33 bp, Artificial Sequence
  Single strand DNA oligonucleotide
aaaggtaccccaaaccacgaattatacattttc

SEQ ID NO: 14777 - DNA, 32 bp, Artificial Sequence
  Single strand DNA oligonucleotide
aaaggtaccttcaaatgactctagcaaaggac

SEQ ID NO: 14778 - DNA, 31 bp, Artificial Sequence
  Single strand DNA oligonucleotide
aaaggtaccaaatggtctttgcagcttcttc

SEQ ID NO: 14779 - DNA, 31 bp, Artificial Sequence
  Single strand DNA oligonucleotide
aaaggtacctgttcaaattcggctacacatc

SEQ ID NO: 14780 - DNA, 31 bp, Artificial Sequence
  Single strand DNA oligonucleotide
aaagaattcgatccctatgtgcagaatcacc

SEQ ID NO: 14781 - DNA, 31 bp, Artificial Sequence
  Single strand DNA oligonucleotide
aaaggtaccgattcacagcaacaaatcatgg

SEQ ID NO: 14782 - DNA, 31 bp, Artificial Sequence
  Single strand DNA oligonucleotide
aaaggtacctggtgcatgagtacattgtgtg

SEQ ID NO: 14783 - DNA, 31 bp, Artificial Sequence
  Single strand DNA oligonucleotide
aaaggtaccaagaacacactgatgcaactgg

SEQ ID NO: 14784 - DNA, 31 bp, Artificial Sequence
  Single strand DNA oligonucleotide
aaaggtaccaagtatgtacaaggcgacctgc

SEQ ID NO: 14785 - DNA, 36 bp, Artificial Sequence
  Single strand DNA oligonucleotide
aaagatatcagaagagatgaacctaatcaactcaag

SEQ ID NO: 14786 - DNA, 30 bp, Artificial Sequence
  Single strand DNA oligonucleotide
aaagaattcaccaccattgaccataagcag

SEQ ID NO: 14787 - DNA, 31 bp, Artificial Sequence
  Single strand DNA oligonucleotide
aaaggtacccagaaccgaatcatcctctcac

SEQ ID NO: 14788 - DNA, 35 bp, Artificial Sequence
  Single strand DNA oligonucleotide
tttggtaccttattagacaatctggacacaggctg

SEQ ID NO: 14789 - DNA, 31 bp, Artificial Sequence
  Single strand DNA oligonucleotide
aaaggtaccatcatactggctctcacaaacc

SEQ ID NO: 14790 - DNA, 33 bp, Artificial Sequence
  Single strand DNA oligonucleotide
aaagaattcctacaagatggaaccgttacaaag

SEQ ID NO: 14791 - DNA, 33 bp, Artificial Sequence
  Single strand DNA oligonucleotide
aaagaattcttacctcattattcacttgattcc

SEQ ID NO: 14792 - DNA, 31 bp, Artificial Sequence
  Single strand DNA oligonucleotide
aaaggtacctggaatgaagtgaagcacatac

SEQ ID NO: 14793 - DNA, 32 bp, Artificial Sequence
  Single strand DNA oligonucleotide
aaaggtaccccaataaggctataacccgtgag

SEQ ID NO: 14794 - DNA, 32 bp, Artificial Sequence
  Single strand DNA oligonucleotide
aaaggatccgaactaaacagagaggcaacatc

SEQ ID NO: 14795 - DNA, 31 bp, Artificial Sequence
  Single strand DNA oligonucleotide
aaagatatctatttaatggccaactttccac

SEQ ID NO: 14796 - DNA, 31 bp, Artificial Sequence
  Single strand DNA oligonucleotide
aaaggtaccgtaacttgcaaagtgctaggtg

SEQ ID NO: 14797 - DNA, 31 bp, Artificial Sequence
  Single strand DNA oligonucleotide
aaagaattcttaatctcacttgtgttggtgc

SEQ ID NO: 14798 - DNA, 31 bp, Artificial Sequence
  Single strand DNA oligonucleotide
aaagaattcgaactcaacctttaccctgaac

SEQ ID NO: 14799 - DNA, 31 bp, Artificial Sequence
  Single strand DNA oligonucleotide
aaaggatccacaaccacaagaacatatcacg

SEQ ID NO: 14800 - DNA, 32 bp, Artificial Sequence
  Single strand DNA oligonucleotide
aaaggtacccaactcgagaatgtaagaattgc

SEQ ID NO: 14801 - DNA, 31 bp, Artificial Sequence
  Single strand DNA oligonucleotide
aaaggtacccagatgcaatgcaacaaataac

SEQ ID NO: 14802 - DNA, 32 bp, Artificial Sequence
  Single strand DNA oligonucleotide
aaaggatcctgtttctattcttcacgcctatg

SEQ ID NO: 14803 - DNA, 32 bp, Artificial Sequence
  Single strand DNA oligonucleotide
aaaggtacctgacatattctttaagcctcagc

SEQ ID NO: 14804 - DNA, 31 bp, Artificial Sequence
  Single strand DNA oligonucleotide
aaaggtaccaactagcatgaatctgccaagc

SEQ ID NO: 14805 - DNA, 31 bp, Artificial Sequence
  Single strand DNA oligonucleotide
aaaaggccttagtcgtaggatcaatgaaacg

SEQ ID NO: 14806 - DNA, 34 bp, Artificial Sequence
  Single strand DNA oligonucleotide
aaagaattcctaaatccttgctaaccagtcccag

SEQ ID NO: 14807 - DNA, 31 bp, Artificial Sequence
  Single strand DNA oligonucleotide
aaaggtaccactatgagattctgtgtgcagc

SEQ ID NO: 14808 - DNA, 36 bp, Artificial Sequence
  Single strand DNA oligonucleotide
tttggatccaactgtttaaacatgtcattcacaagc

SEQ ID NO: 14809 - DNA, 31 bp, Artificial Sequence
  Single strand DNA oligonucleotide
aaaggtacctctcaatatgacagtccacagg

SEQ ID NO: 14810 - DNA, 30 bp, Artificial Sequence
  Single strand DNA oligonucleotide
tttggtaccgaagcctcatatggatgcaag

SEQ ID NO: 14811 - DNA, 30 bp, Artificial Sequence
  Single strand DNA oligonucleotide
aaaggatccgagaattacggaaagggaaac

SEQ ID NO: 14812 - DNA, 33 bp, Artificial Sequence
  Single strand DNA oligonucleotide
aaagaattcccacattcatagttaacaccattc

SEQ ID NO: 14813 - DNA, 38 bp, Artificial Sequence
  Single strand DNA oligonucleotide
tttggtaccttagtagaagccttagttattgcaagagc

SEQ ID NO: 14814 - DNA, 31 bp, Artificial Sequence
  Single strand DNA oligonucleotide
aaaggtaccgagtcttgcatcttcatctttg

SEQ ID NO: 14815 - DNA, 31 bp, Artificial Sequence
  Single strand DNA oligonucleotide
aaaggatcctaaaccacaacttgaaatggaa

SEQ ID NO: 14816 - DNA, 31 bp, Artificial Sequence
  Single strand DNA oligonucleotide
aaaggtaccttaagcacaggtaatgtgaacc

SEQ ID NO: 14817 - DNA, 31 bp, Artificial Sequence
  Single strand DNA oligonucleotide
aaaggtaccaacggctcatcaagtagtccag

SEQ ID NO: 14818 - DNA, 31 bp, Artificial Sequence
  Single strand DNA oligonucleotide
aaaggtaccttcgcaaagagttcaacattag

SEQ ID NO: 14819 - DNA, 31 bp, Artificial Sequence
  Single strand DNA oligonucleotide
aaaaggcctaatcaaggtccattaaatttgc

SEQ ID NO: 14820 - DNA, 31 bp, Artificial Sequence
  Single strand DNA oligonucleotide
aaaggtacccttctgggagcattacattcac

SEQ ID NO: 14821 - DNA, 31 bp, Artificial Sequence
  Single strand DNA oligonucleotide
aaaggatcccctacatcaaacacgagacatc

SEQ ID NO: 14822 - DNA, 33 bp, Artificial Sequence
  Single strand DNA oligonucleotide
aaagaattccctcgataattgagttgaggtttc

SEQ ID NO: 14823 - DNA, 35 bp, Artificial Sequence
  Single strand DNA oligonucleotide
aaagaattcttaccaacctaaagaattatcacaac

SEQ ID NO: 14824 - DNA, 31 bp, Artificial Sequence
  Single strand DNA oligonucleotide
aaaggatccaaattggtgacttcaacacaag

SEQ ID NO: 14825 - DNA, 33 bp, Artificial Sequence
  Single strand DNA oligonucleotide
aaaaggccttcaacaaatgcaatacaatgggac

SEQ ID NO: 14826 - DNA, 32 bp, Artificial Sequence
  Single strand DNA oligonucleotide
aaagaattcaatccttcggttcttcgtttaag

SEQ ID NO: 14827 - DNA, 31 bp, Artificial Sequence
  Single strand DNA oligonucleotide
aaaggatccacgtatcgatagcacagatttc

SEQ ID NO: 14828 - DNA, 32 bp, Artificial Sequence
  Single strand DNA oligonucleotide
aaagaattcaaacttggtaacagctaacatgc

SEQ ID NO: 14829 - DNA, 33 bp, Artificial Sequence
  Single strand DNA oligonucleotide
aaaggtaccctagatgtgtcgtaaacggtcaac

SEQ ID NO: 14830 - DNA, 35 bp, Artificial Sequence
  Single strand DNA oligonucleotide
aaagaattcctacattgactcatgcactacagcag

SEQ ID NO: 14831 - DNA, 31 bp, Artificial Sequence
  Single strand DNA oligonucleotide
aaaggtaccatggtgtagacagcatctcttg

SEQ ID NO: 14832 - DNA, 31 bp, Artificial Sequence
  Single strand DNA oligonucleotide
aaaggtacccgctcagttctggtcactacac

SEQ ID NO: 14833 - DNA, 35 bp, Artificial Sequence
  Single strand DNA oligonucleotide
aaaggtaccctaaaccgaattccataagccataag

SEQ ID NO: 14834 - DNA, 33 bp, Artificial Sequence
  Single strand DNA oligonucleotide
aaaggtacccgtacgtagtaagtaacccatcag

SEQ ID NO: 14835 - DNA, 35 bp, Artificial Sequence
  Single strand DNA oligonucleotide
aaaggtaccttattattccaagtctagaatgccga

SEQ ID NO: 14836 - DNA, 24 bp, Artificial Sequence
  Single strand DNA oligonucleotide
gttcatggatggatcttactttcc

SEQ ID NO: 14837 - DNA, 31 bp, Artificial Sequence
  Single strand DNA oligonucleotide
aaaggtacccatctttgttgttccaatccag

SEQ ID NO: 14838 - DNA, 27 bp, Artificial Sequence
  Single strand DNA oligonucleotide
aaaaggcctggtatggtccctcaatgg

SEQ ID NO: 14839 - DNA, 31 bp, Artificial Sequence
  Single strand DNA oligonucleotide
aaagaattcattgagtccacggtgaatgaag

SEQ ID NO: 14840 - DNA, 31 bp, Artificial Sequence
  Single strand DNA oligonucleotide
aaaggtaccacataagagcatatcccaaagg

SEQ ID NO: 14841 - DNA, 31 bp, Artificial Sequence
  Single strand DNA oligonucleotide
aaaggtaccatatctctcacacagccatgag

SEQ ID NO: 14842 - DNA, 36 bp, Artificial Sequence
  Single strand DNA oligonucleotide
aaaggtacctgttgctatttaaaggaatcaaacaac

SEQ ID NO: 14843 - DNA, 31 bp, Artificial Sequence
  Single strand DNA oligonucleotide
aaaggtaccaagcttcaaaccaatcgtgttc

SEQ ID NO: 14844 - DNA, 31 bp, Artificial Sequence
  Single strand DNA oligonucleotide
aaagaattctcagaatgttcgactagcatgg

SEQ ID NO: 14845 - DNA, 34 bp, Artificial Sequence
  Single strand DNA oligonucleotide
tttggtaccctactaactggtgaactggtcctgc

SEQ ID NO: 14846 - DNA, 31 bp, Artificial Sequence
  Single strand DNA oligonucleotide
aaaggtaccttcagtgttcagtgtctcctcg

SEQ ID NO: 14847 - DNA, 32 bp, Artificial Sequence
  Single strand DNA oligonucleotide
aaaggtacccactgcttgctacacaatgtacg

SEQ ID NO: 14848 - DNA, 31 bp, Artificial Sequence
  Single strand DNA oligonucleotide
aaagaattcagatccaagacaacaagacagg

SEQ ID NO: 14849 - DNA, 31 bp, Artificial Sequence
  Single strand DNA oligonucleotide
aaaggtaccaacaccaatagtaccgcaattc

SEQ ID NO: 14850 - DNA, 31 bp, Artificial Sequence
  Single strand DNA oligonucleotide
aaaggtacctgaccatatccttagaccgcac

SEQ ID NO: 14851 - DNA, 31 bp, Artificial Sequence
  Single strand DNA oligonucleotide
aaaggtaccgatccacactcaaactgtgaag

SEQ ID NO: 14852 - DNA, 34 bp, Artificial Sequence
  Single strand DNA oligonucleotide
aaaggatcctgagacttaaatcaatagttggagc

SEQ ID NO: 14853 - DNA, 31 bp, Artificial Sequence
  Single strand DNA oligonucleotide
aaaggtaccccgcccataatttacacataag

SEQ ID NO: 14854 - DNA, 31 bp, Artificial Sequence
  Single strand DNA oligonucleotide
aaaggtaccattcggcatttgaaaccttacc

SEQ ID NO: 14855 - DNA, 34 bp, Artificial Sequence
  Single strand DNA oligonucleotide
aaagaattcccagaatttacagtacacacaaatc

SEQ ID NO: 14856 - DNA, 33 bp, Artificial Sequence
  Single strand DNA oligonucleotide
tttggtaccagcttacatgcataacacttgttc

SEQ ID NO: 14857 - DNA, 40 bp, Artificial Sequence
  Single strand DNA oligonucleotide
tttggtaccttttctcataagtgttggctattatttaaac

SEQ ID NO: 14858 - DNA, 32 bp, Artificial Sequence
  Single strand DNA oligonucleotide
aaaggatccttataacctcttcgtcttcttcg

SEQ ID NO: 14859 - DNA, 29 bp, Artificial Sequence
  Single strand DNA oligonucleotide
aaagtcgacgatttcgtttctgggttgtg

SEQ ID NO: 14860 - DNA, 32 bp, Artificial Sequence
  Single strand DNA oligonucleotide
aaaggatcctgacttgccttctcaatacaaac

SEQ ID NO: 14861 - DNA, 31 bp, Artificial Sequence
  Single strand DNA oligonucleotide
aaagtcgactccgataaacccacaaataaag

SEQ ID NO: 14862 - DNA, 31 bp, Artificial Sequence
  Single strand DNA oligonucleotide
aaagtcgacctcaaacaacccaatctaaatg

SEQ ID NO: 14863 - DNA, 30 bp, Artificial Sequence
  Single strand DNA oligonucleotide
aaaggatccagacacacaaacccactgaac

SEQ ID NO: 14864 - DNA, 32 bp, Artificial Sequence
  Single strand DNA oligonucleotide
aaagtcgactcttgattctctcttccactgtc

SEQ ID NO: 14865 - DNA, 31 bp, Artificial Sequence
  Single strand DNA oligonucleotide
aaaggatcctagatctgctcaccatttctcc

SEQ ID NO: 14866 - DNA, 31 bp, Artificial Sequence
  Single strand DNA oligonucleotide
aaaggatccctccatctctgtctccggtaag

SEQ ID NO: 14867 - DNA, 31 bp, Artificial Sequence
  Single strand DNA oligonucleotide
aaaggatccctcctacaaatctggaatcagc

SEQ ID NO: 14868 - DNA, 31 bp, Artificial Sequence
  Single strand DNA oligonucleotide
aaaggatcctaagataagaatgccttcggtg

SEQ ID NO: 14869 - DNA, 31 bp, Artificial Sequence
  Single strand DNA oligonucleotide
aaaggatccaaacatcaaggagcatctcttc

SEQ ID NO: 14870 - DNA, 29 bp, Artificial Sequence
  Single strand DNA oligonucleotide
aaaggatccttcaatcgtgaaatcgaaac

SEQ ID NO: 14871 - DNA, 28 bp, Artificial Sequence
  Single strand DNA oligonucleotide
aaaggatccgaataatgagcgcggttag

SEQ ID NO: 14872 - DNA, 32 bp, Artificial Sequence
  Single strand DNA oligonucleotide
aaaggatccaaatcattcgttaatcaaaccac

SEQ ID NO: 14873 - DNA, 31 bp, Artificial Sequence
  Single strand DNA oligonucleotide
aaagtcgaccgtctcaattacagaacaaagc

SEQ ID NO: 14874 - DNA, 31 bp, Artificial Sequence
  Single strand DNA oligonucleotide
aaaggatcccacctctctttgttggactctc

SEQ ID NO: 14875 - DNA, 31 bp, Artificial Sequence
  Single strand DNA oligonucleotide
aaaggatccaaagatctcgttcaatttcacc

SEQ ID NO: 14876 - DNA, 30 bp, Artificial Sequence
  Single strand DNA oligonucleotide
aaaggatcccgaccaaaagaagtgagagag

SEQ ID NO: 14877 - DNA, 28 bp, Artificial Sequence
  Single strand DNA oligonucleotide
aatggatccaaaccctacccgagcagtc

SEQ ID NO: 14878 - DNA, 31 bp, Artificial Sequence
  Single strand DNA oligonucleotide
aaaggatcctgaaatcttcttgttggatgtg

SEQ ID NO: 14879 - DNA, 31 bp, Artificial Sequence
  Single strand DNA oligonucleotide
aaaggatcctcatccaaacaatacacagtcc

SEQ ID NO: 14880 - DNA, 31 bp, Artificial Sequence
  Single strand DNA oligonucleotide
aaaggatccattgcctcttgaagtcaatcac

SEQ ID NO: 14881 - DNA, 32 bp, Artificial Sequence
  Single strand DNA oligonucleotide
aaaggatcctgatcatctctcaggtgaatacg

SEQ ID NO: 14882 - DNA, 31 bp, Artificial Sequence
  Single strand DNA oligonucleotide
aaaggatccatatgaatggaatccaatttcg

SEQ ID NO: 14883 - DNA, 32 bp, Artificial Sequence
  Single strand DNA oligonucleotide
aaagtcgactcatcactcatctgttatcttcc

SEQ ID NO: 14884 - DNA, 32 bp, Artificial Sequence
  Single strand DNA oligonucleotide
aaaggatccggaggtttcttccctagtagacc

SEQ ID NO: 14885 - DNA, 29 bp, Artificial Sequence
  Single strand DNA oligonucleotide
aaagtcgaccaaaagaagcggaaacagag

SEQ ID NO: 14886 - DNA, 32 bp, Artificial Sequence
  Single strand DNA oligonucleotide
aaaggatccccttcaagaacacaaagctagac

SEQ ID NO: 14887 - DNA, 30 bp, Artificial Sequence
  Single strand DNA oligonucleotide
aaagtcgaccttcttcccgatgtatcagtg

SEQ ID NO: 14888 - DNA, 36 bp, Artificial Sequence
  Single strand DNA oligonucleotide
aaagtcgacttaactctttaagatctgaggtgatgg

SEQ ID NO: 14889 - DNA, 27 bp, Artificial Sequence
  Single strand DNA oligonucleotide
aaaggatccgccaaaatgggtgcagac

SEQ ID NO: 14890 - DNA, 31 bp, Artificial Sequence
  Single strand DNA oligonucleotide
aaagtcgactctgtaactgaggcttctccag

SEQ ID NO: 14891 - DNA, 31 bp, Artificial Sequence
  Single strand DNA oligonucleotide
aaaggatcctcatcctccattgaagtaactg

SEQ ID NO: 14892 - DNA, 28 bp, Artificial Sequence
  Single strand DNA oligonucleotide
aaaggatccgtgaacagtcgggaggaag

SEQ ID NO: 14893 - DNA, 30 bp, Artificial Sequence
  Single strand DNA oligonucleotide
aaaggatccgtgctctcgtcttcgatctcc

SEQ ID NO: 14894 - DNA, 31 bp, Artificial Sequence
  Single strand DNA oligonucleotide
aaagtcgacgaaactacccttgtctcctcca

SEQ ID NO: 14895 - DNA, 33 bp, Artificial Sequence
  Single strand DNA oligonucleotide
aaaggatccactaattcaaaggatcaagaaacc

SEQ ID NO: 14896 - DNA, 34 bp, Artificial Sequence
  Single strand DNA oligonucleotide
aaagtcgacttaccttctacgcaggtttgtaatc

SEQ ID NO: 14897 - DNA, 31 bp, Artificial Sequence
  Single strand DNA oligonucleotide
aaagtcgactctccgtatctggtgatgagtg

SEQ ID NO: 14898 - DNA, 31 bp, Artificial Sequence
  Single strand DNA oligonucleotide
aaagatatcatcagagaggagagtgatttgg

SEQ ID NO: 14899 - DNA, 27 bp, Artificial Sequence
  Single strand DNA oligonucleotide
aaagtcgacaagaaatggccccagggt

SEQ ID NO: 14900 - DNA, 30 bp, Artificial Sequence
  Single strand DNA oligonucleotide
aaagtcgaccttgcaaataattgaagcagc

SEQ ID NO: 14901 - DNA, 31 bp, Artificial Sequence
  Single strand DNA oligonucleotide
aaagtcgaccttgttgggtttagggtgaaac

SEQ ID NO: 14902 - DNA, 32 bp, Artificial Sequence
  Single strand DNA oligonucleotide
aaaggatccggaagttgtttaacaccaatcac

SEQ ID NO: 14903 - DNA, 30 bp, Artificial Sequence
  Single strand DNA oligonucleotide
aaaggatcctaaccctagccacatcttcac

SEQ ID NO: 14904 - DNA, 31 bp, Artificial Sequence
  Single strand DNA oligonucleotide
aaaggatcccgcttcatctgtctcatcttcc

SEQ ID NO: 14905 - DNA, 34 bp, Artificial Sequence
  Single strand DNA oligonucleotide
aaaggatccaaatcataggaatgaaactgtgaac

SEQ ID NO: 14906 - DNA, 28 bp, Artificial Sequence
  Single strand DNA oligonucleotide
aaaggatccagcaaagaccaaagagctg

SEQ ID NO: 14907 - DNA, 32 bp, Artificial Sequence
  Single strand DNA oligonucleotide
aaactcgagcacataccctctttcttcaattc

SEQ ID NO: 14908 - DNA, 35 bp, Artificial Sequence
  Single strand DNA oligonucleotide
aaaggatcctgttacacctagagagagaaagagag

SEQ ID NO: 14909 - DNA, 31 bp, Artificial Sequence
  Single strand DNA oligonucleotide
aaactcgagtaatggcgaagtgaatgaatac

SEQ ID NO: 14910 - DNA, 32 bp, Artificial Sequence
  Single strand DNA oligonucleotide
aaaggatccccttcccttcactctagtcagtc

SEQ ID NO: 14911 - DNA, 32 bp, Artificial Sequence
  Single strand DNA oligonucleotide
aaagtcgaccaccatggttctattctaagcac

SEQ ID NO: 14912 - DNA, 30 bp, Artificial Sequence
  Single strand DNA oligonucleotide
aaagtcgacggccttacctcatctcttctc

SEQ ID NO: 14913 - DNA, 33 bp, Artificial Sequence
  Single strand DNA oligonucleotide
aaaggatccagtctgaacaaactcaactcacac

SEQ ID NO: 14914 - DNA, 33 bp, Artificial Sequence
  Single strand DNA oligonucleotide
aaagtcgacaaacaaagaagcacaaaatgaagg

SEQ ID NO: 14915 - DNA, 31 bp, Artificial Sequence
  Single strand DNA oligonucleotide
aaagtcgaccattcctcacatatcaaccaac

SEQ ID NO: 14916 - DNA, 29 bp, Artificial Sequence
  Single strand DNA oligonucleotide
aaagtcgacccaaacatcatcaatcttcg

SEQ ID NO: 14917 - DNA, 35 bp, Artificial Sequence
  Single strand DNA oligonucleotide
aaaggatccccttcccttcttaaataaataatcac

SEQ ID NO: 14918 - DNA, 30 bp, Artificial Sequence
  Single strand DNA oligonucleotide
aaaggatccacgcacacagaaacactctcc

SEQ ID NO: 14919 - DNA, 27 bp, Artificial Sequence
  Single strand DNA oligonucleotide
aaaggatcccgccgattaacatccgac

SEQ ID NO: 14920 - DNA, 31 bp, Artificial Sequence
  Single strand DNA oligonucleotide
aaaggatcctgaggtcaggagtgattgattg

SEQ ID NO: 14921 - DNA, 31 bp, Artificial Sequence
  Single strand DNA oligonucleotide
aaaggatccctcaaactccttgcattctttc

SEQ ID NO: 14922 - DNA, 31 bp, Artificial Sequence
  Single strand DNA oligonucleotide
aaagtcgacgcaagcattcataaagcataac

SEQ ID NO: 14923 - DNA, 33 bp, Artificial Sequence
  Single strand DNA oligonucleotide
aaagtcgactccatcattgcttataattctctg

SEQ ID NO: 14924 - DNA, 34 bp, Artificial Sequence
  Single strand DNA oligonucleotide
aaaggatccacgctagttcaactcaaccaattac

SEQ ID NO: 14925 - DNA, 30 bp, Artificial Sequence
  Single strand DNA oligonucleotide
aaagtcgactgtttccagtttccaactttc

SEQ ID NO: 14926 - DNA, 31 bp, Artificial Sequence
  Single strand DNA oligonucleotide
aaagtcgacgatttgagcctctctcagtgac

SEQ ID NO: 14927 - DNA, 29 bp, Artificial Sequence
  Single strand DNA oligonucleotide
aaagtcgacctgataacccataaccgacc

SEQ ID NO: 14928 - DNA, 31 bp, Artificial Sequence
  Single strand DNA oligonucleotide
aaactcgaggttgtctccgttcattacatcg

SEQ ID NO: 14929 - DNA, 31 bp, Artificial Sequence
  Single strand DNA oligonucleotide
aaaggatcctggagtaattcattctctggtg

SEQ ID NO: 14930 - DNA, 29 bp, Artificial Sequence
  Single strand DNA oligonucleotide
aaagtcgacggtttcactcccatcaacag

SEQ ID NO: 14931 - DNA, 29 bp, Artificial Sequence
  Single strand DNA oligonucleotide
aaaggatcccgatattcgacaagctcaag

SEQ ID NO: 14932 - DNA, 29 bp, Artificial Sequence
  Single strand DNA oligonucleotide
aaaggatccgttgacccgaccacttattc

SEQ ID NO: 14933 - DNA, 31 bp, Artificial Sequence
  Single strand DNA oligonucleotide
aaagtcgacgaggatttgaagcagagatagc

SEQ ID NO: 14934 - DNA, 31 bp, Artificial Sequence
  Single strand DNA oligonucleotide
aaaggatcctatttcattgggtatgttgctg

SEQ ID NO: 14935 - DNA, 31 bp, Artificial Sequence
  Single strand DNA oligonucleotide
aaagtcgacacagaaacgagacccattattc

SEQ ID NO: 14936 - DNA, 32 bp, Artificial Sequence
  Single strand DNA oligonucleotide
aaagtcgacaacagagagacgattcaatttgc

SEQ ID NO: 14937 - DNA, 31 bp, Artificial Sequence
  Single strand DNA oligonucleotide
aaactcgagtactgtgcttctcaccattagc

SEQ ID NO: 14938 - DNA, 34 bp, Artificial Sequence
  Single strand DNA oligonucleotide
tttctcgagactattttgcctatttctgatctga

SEQ ID NO: 14939 - DNA, 31 bp, Artificial Sequence
  Single strand DNA oligonucleotide
aaagtcgacttcatattatgcccaacaagtg

SEQ ID NO: 14940 - DNA, 32 bp, Artificial Sequence
  Single strand DNA oligonucleotide
aaagtcgacccgatctatttctctacctctcc

SEQ ID NO: 14941 - DNA, 32 bp, Artificial Sequence
  Single strand DNA oligonucleotide
aaaggatcctgacacatcaccatatcttcttc

SEQ ID NO: 14942 - DNA, 31 bp, Artificial Sequence
  Single strand DNA oligonucleotide
aaagtcgacaacgatttgctcaacaacgaac

SEQ ID NO: 14943 - DNA, 31 bp, Artificial Sequence
  Single strand DNA oligonucleotide
aaaggatccgtttatccagcgaagctagcag

SEQ ID NO: 14944 - DNA, 31 bp, Artificial Sequence
  Single strand DNA oligonucleotide
aaaggatccctagctctccgagggtctcttc

SEQ ID NO: 14945 - DNA, 31 bp, Artificial Sequence
  Single strand DNA oligonucleotide
aaaggatcctctcagtttaagcacgttctgg

SEQ ID NO: 14946 - DNA, 31 bp, Artificial Sequence
  Single strand DNA oligonucleotide
aaagtcgaccccttggctcctactcactctc

SEQ ID NO: 14947 - DNA, 34 bp, Artificial Sequence
  Single strand DNA oligonucleotide
aaaggatccgggttttactcaatttcaagattcg

SEQ ID NO: 14948 - DNA, 31 bp, Artificial Sequence
  Single strand DNA oligonucleotide
aaaggatccgaagagacttgcaaagtggagg

SEQ ID NO: 14949 - DNA, 29 bp, Artificial Sequence
  Single strand DNA oligonucleotide
aaagatatctcgcactcacactagcaacc

SEQ ID NO: 14950 - DNA, 31 bp, Artificial Sequence
  Single strand DNA oligonucleotide
aaaggatccttacgcacccaagagagagaag

SEQ ID NO: 14951 - DNA, 31 bp, Artificial Sequence
  Single strand DNA oligonucleotide
aaaggatccataaagctagccggagatgatg

SEQ ID NO: 14952 - DNA, 28 bp, Artificial Sequence
  Single strand DNA oligonucleotide
aaaggatccttagcaaaatccatggcag

SEQ ID NO: 14953 - DNA, 31 bp, Artificial Sequence
  Single strand DNA oligonucleotide
aaagtcgacgtatttgttctccgtcatctcg

SEQ ID NO: 14954 - DNA, 28 bp, Artificial Sequence
  Single strand DNA oligonucleotide
aaagtcgaccagcatcgcagttacagag

SEQ ID NO: 14955 - DNA, 33 bp, Artificial Sequence
  Single strand DNA oligonucleotide
aaaggtaccctaacagagaacacaagacccttc

SEQ ID NO: 14956 - DNA, 31 bp, Artificial Sequence
  Single strand DNA oligonucleotide
aaaaggcctgccacaactacattcaactacg

SEQ ID NO: 14957 - DNA, 29 bp, Artificial Sequence
  Single strand DNA oligonucleotide
aaaggtaccattgagtcacaaagggaagc

SEQ ID NO: 14958 - DNA, 34 bp, Artificial Sequence
  Single strand DNA oligonucleotide
aaagagctcctacaaactaaatcgaacacaaagc

SEQ ID NO: 14959 - DNA, 31 bp, Artificial Sequence
  Single strand DNA oligonucleotide
aaaggtacctcgaacaagaaagaaacctctc

SEQ ID NO: 14960 - DNA, 31 bp, Artificial Sequence
  Single strand DNA oligonucleotide
aaagatatctgtatcgttggtctcattcatc

SEQ ID NO: 14961 - DNA, 31 bp, Artificial Sequence
  Single strand DNA oligonucleotide
aaaggatccgaccattgcttgagagagttcc

SEQ ID NO: 14962 - DNA, 31 bp, Artificial Sequence
  Single strand DNA oligonucleotide
aaaggtaccacaaacgctgatcctaaacttc

SEQ ID NO: 14963 - DNA, 31 bp, Artificial Sequence
  Single strand DNA oligonucleotide
aaaggtaccagagagccaatcgtagctgatg

SEQ ID NO: 14964 - DNA, 31 bp, Artificial Sequence
  Single strand DNA oligonucleotide
aaaggtaccattcatctacttctgcgaaagc

SEQ ID NO: 14965 - DNA, 31 bp, Artificial Sequence
  Single strand DNA oligonucleotide
aaaggtaccatcatacaagaggaagccaaac

SEQ ID NO: 14966 - DNA, 31 bp, Artificial Sequence
  Single strand DNA oligonucleotide
aaagaattctaagtgggttcgggtactattg

SEQ ID NO: 14967 - DNA, 34 bp, Artificial Sequence
  Single strand DNA oligonucleotide
aaaggtaccgaatgtcaattacaaacattgaagc

SEQ ID NO: 14968 - DNA, 33 bp, Artificial Sequence
  Single strand DNA oligonucleotide
aaaggtaccctatgctttacacagatcacatgc

SEQ ID NO: 14969 - DNA, 31 bp, Artificial Sequence
  Single strand DNA oligonucleotide
aaaggtacctcgatatgttaacgtgaagacc

SEQ ID NO: 14970 - DNA, 32 bp, Artificial Sequence
  Single strand DNA oligonucleotide
aaagaattcaaagctcttcatcagtatcaacg

SEQ ID NO: 14971 - DNA, 31 bp, Artificial Sequence
  Single strand DNA oligonucleotide
aaaggtaccttcaaactgtaaacctcactgc

SEQ ID NO: 14972 - DNA, 28 bp, Artificial Sequence
  Single strand DNA oligonucleotide
aaaggtaccaaccgacgtcttgttcttg

SEQ ID NO: 14973 - DNA, 36 bp, Artificial Sequence
  Single strand DNA oligonucleotide
aaaggtaccctaagtgttttgattctggaagatatg

SEQ ID NO: 14974 - DNA, 34 bp, Artificial Sequence
  Single strand DNA oligonucleotide
aaaggtaccctacgagtagtcacagaacgacagc

SEQ ID NO: 14975 - DNA, 34 bp, Artificial Sequence
  Single strand DNA oligonucleotide
aaaggtaccctataattccacgaaaccagtaagg

SEQ ID NO: 14976 - DNA, 28 bp, Artificial Sequence
  Single strand DNA oligonucleotide
aaaggtacctatcaagcctccatcatcg

SEQ ID NO: 14977 - DNA, 31 bp, Artificial Sequence
  Single strand DNA oligonucleotide
aaaggtaccagaccatacattggtggttctc

SEQ ID NO: 14978 - DNA, 31 bp, Artificial Sequence
  Single strand DNA oligonucleotide
aaaggtaccgattctcgatcaccagcatacc

SEQ ID NO: 14979 - DNA, 33 bp, Artificial Sequence
  Single strand DNA oligonucleotide
aaaggtacctgtgctattacctactacccttgg

SEQ ID NO: 14980 - DNA, 31 bp, Artificial Sequence
  Single strand DNA oligonucleotide
aaaggtaccacacggctttagaaactctctc

SEQ ID NO: 14981 - DNA, 31 bp, Artificial Sequence
  Single strand DNA oligonucleotide
aaagaattcatcaatccttgtgtttcaactg

SEQ ID NO: 14982 - DNA, 33 bp, Artificial Sequence
  Single strand DNA oligonucleotide
aaaggtaccgccagaaactctgtaacactaaac

SEQ ID NO: 14983 - DNA, 33 bp, Artificial Sequence
  Single strand DNA oligonucleotide
aaaggtaccctacggagttatggtcaaacaaag

SEQ ID NO: 14984 - DNA, 31 bp, Artificial Sequence
  Single strand DNA oligonucleotide
aaagaattcaggcactgcaaataaaataagc

SEQ ID NO: 14985 - DNA, 35 bp, Artificial Sequence
  Single strand DNA oligonucleotide
aaaggtaccctaaaagccaatgtgactacaacaac

SEQ ID NO: 14986 - DNA, 31 bp, Artificial Sequence
  Single strand DNA oligonucleotide
aaagaattcagtctgagaattgctgttgttg

SEQ ID NO: 14987 - DNA, 35 bp, Artificial Sequence
  Single strand DNA oligonucleotide
tttggtaccctactacagtgtctggaagaacctgc

SEQ ID NO: 14988 - DNA, 34 bp, Artificial Sequence
  Single strand DNA oligonucleotide
aaagaattcgaatccatagacatggaacattaac

SEQ ID NO: 14989 - DNA, 34 bp, Artificial Sequence
  Single strand DNA oligonucleotide
aaaggtacccaaacgttacaagaagactatggac

SEQ ID NO: 14990 - DNA, 35 bp, Artificial Sequence
  Single strand DNA oligonucleotide
aaaaggcctctagacgaagcagcataatatgaaag

SEQ ID NO: 14991 - DNA, 34 bp, Artificial Sequence
  Single strand DNA oligonucleotide
aaaggatccctacatccaaatgacttgcttcttg

SEQ ID NO: 14992 - DNA, 31 bp, Artificial Sequence
  Single strand DNA oligonucleotide
aaaggtaccacatgccaaacaagactcacag

SEQ ID NO: 14993 - DNA, 32 bp, Artificial Sequence
  Single strand DNA oligonucleotide
aaaggtacctggcatctaatctcttcatcaac

SEQ ID NO: 14994 - DNA, 31 bp, Artificial Sequence
  Single strand DNA oligonucleotide
aaaggtaccgcaggattcaaacgacacatag

SEQ ID NO: 14995 - DNA, 31 bp, Artificial Sequence
  Single strand DNA oligonucleotide
aaagatatcagatgagtctggtcgttcactg

SEQ ID NO: 14996 - DNA, 34 bp, Artificial Sequence
  Single strand DNA oligonucleotide
aaaggtaccctagttggttagctccatgactttg

SEQ ID NO: 14997 - DNA, 36 bp, Artificial Sequence
  Single strand DNA oligonucleotide
aaaaggcctctaacgtaggttcaagtcaaactgttg

SEQ ID NO: 14998 - DNA, 31 bp, Artificial Sequence
  Single strand DNA oligonucleotide
aaactcgagctctaacaccgcaaacctaaac

SEQ ID NO: 14999 - DNA, 32 bp, Artificial Sequence
  Single strand DNA oligonucleotide
aaaggatccggaacatgatgacacttacactg

SEQ ID NO: 15000 - DNA, 36 bp, Artificial Sequence
  Single strand DNA oligonucleotide
aaagaattcctaattgattacaaagttggctaagtg

SEQ ID NO: 15001 - DNA, 31 bp, Artificial Sequence
  Single strand DNA oligonucleotide
aaagaattcaggcaagaaggcttacacacag

SEQ ID NO: 15002 - DNA, 31 bp, Artificial Sequence
  Single strand DNA oligonucleotide
aaaggtacccgccaaatccatttattaagac

SEQ ID NO: 15003 - DNA, 32 bp, Artificial Sequence
  Single strand DNA oligonucleotide
tttggtacctcaacaccatcagttgccaaatc

SEQ ID NO: 15004 - DNA, 31 bp, Artificial Sequence
  Single strand DNA oligonucleotide
aaaggtaccacatcattcatgtccacgagag

SEQ ID NO: 15005 - DNA, 31 bp, Artificial Sequence
  Single strand DNA oligonucleotide
aaagagctcacactcttcaaagacctcatca

SEQ ID NO: 15006 - DNA, 31 bp, Artificial Sequence
  Single strand DNA oligonucleotide
aaaggtaccaccggtttagtgacttagcaac

SEQ ID NO: 15007 - DNA, 31 bp, Artificial Sequence
  Single strand DNA oligonucleotide
aaaggtacctcaagagctttatttgcatcac

SEQ ID NO: 15008 - DNA, 34 bp, Artificial Sequence
  Single strand DNA oligonucleotide
aaagaattcctatcagtactcactccaactctcc

SEQ ID NO: 15009 - DNA, 34 bp, Artificial Sequence
  Single strand DNA oligonucleotide
aaaggtaccctatccatcaaagaacacatttctg

SEQ ID NO: 15010 - DNA, 31 bp, Artificial Sequence
  Single strand DNA oligonucleotide
aaagaattcatacaagaaatgcccttctcac

SEQ ID NO: 15011 - DNA, 31 bp, Artificial Sequence
  Single strand DNA oligonucleotide
aaaggtaccttaaacaaccatctccactgtc

SEQ ID NO: 15012 - DNA, 32 bp, Artificial Sequence
  Single strand DNA oligonucleotide
aaagaattcggctcctaatgtaatctagcctg

SEQ ID NO: 15013 - DNA, 29 bp, Artificial Sequence
  Single strand DNA oligonucleotide
tttgaattccaagcattattattgcgtgc

SEQ ID NO: 15014 - DNA, 31 bp, Artificial Sequence
  Single strand DNA oligonucleotide
aaaggtaccatgcttaacccatatgaaccac

SEQ ID NO: 15015 - DNA, 31 bp, Artificial Sequence
  Single strand DNA oligonucleotide
aaaggtacccacaagaataacgcactttcac

SEQ ID NO: 15016 - DNA, 31 bp, Artificial Sequence
  Single strand DNA oligonucleotide
aaagaattcaatacatgatgaacaacgcaac

SEQ ID NO: 15017 - DNA, 31 bp, Artificial Sequence
  Single strand DNA oligonucleotide
aaaggtaccctgctgcttaattacttcccac

SEQ ID NO: 15018 - DNA, 36 bp, Artificial Sequence
  Single strand DNA oligonucleotide
aaaggatccggtacccaaatctatcaattaagttag

SEQ ID NO: 15019 - DNA, 31 bp, Artificial Sequence
  Single strand DNA oligonucleotide
aaaggatccggaaatttctgcattacagcac

SEQ ID NO: 15020 - DNA, 31 bp, Artificial Sequence
  Single strand DNA oligonucleotide
aaaggtaccaatataactggcacgccatatc

SEQ ID NO: 15021 - DNA, 32 bp, Artificial Sequence
  Single strand DNA oligonucleotide
aaaggtaccctagcaaatcggtgtttcttgtc

SEQ ID NO: 15022 - DNA, 31 bp, Artificial Sequence
  Single strand DNA oligonucleotide
aaagaattccaaggatctgcatgacaatgac

SEQ ID NO: 15023 - DNA, 31 bp, Artificial Sequence
  Single strand DNA oligonucleotide
aaaggtacctgttcacgtctgagaacgaaag

SEQ ID NO: 15024 - DNA, 31 bp, Artificial Sequence
  Single strand DNA oligonucleotide
aaaggtaccactggaaaccttgcatttcaac

SEQ ID NO: 15025 - DNA, 31 bp, Artificial Sequence
  Single strand DNA oligonucleotide
aaaggtaccttacagttacaggtcgctgtgg

SEQ ID NO: 15026 - DNA, 34 bp, Artificial Sequence
  Single strand DNA oligonucleotide
aaaggtaccctacagttccagaatcaaagtccag

SEQ ID NO: 15027 - DNA, 34 bp, Artificial Sequence
  Single strand DNA oligonucleotide
aaagaattcctaagcaagacatccactttcattc

SEQ ID NO: 15028 - DNA, 31 bp, Artificial Sequence
  Single strand DNA oligonucleotide
aaagaattccctattaccaccatcaacaagg

SEQ ID NO: 15029 - DNA, 31 bp, Artificial Sequence
  Single strand DNA oligonucleotide
aaaggtacctaaccataacagtggcatcatc

SEQ ID NO: 15030 - DNA, 31 bp, Artificial Sequence
  Single strand DNA oligonucleotide
aaaggtaccgaaacatgtaggcacaacttgc

SEQ ID NO: 15031 - DNA, 30 bp, Artificial Sequence
  Single strand DNA oligonucleotide
aaagaattcttgcaatgctctattcattcc

SEQ ID NO: 15032 - DNA, 31 bp, Artificial Sequence
  Single strand DNA oligonucleotide
aaagaattcacatgtaaccagaagcattgtc

SEQ ID NO: 15033 - DNA, 31 bp, Artificial Sequence
  Single strand DNA oligonucleotide
aaaggatccactagccaactccatgagaatc

SEQ ID NO: 15034 - DNA, 35 bp, Artificial Sequence
  Single strand DNA oligonucleotide
aaaggatccctagcagttaactacctccaaattcc

SEQ ID NO: 15035 - DNA, 31 bp, Artificial Sequence
  Single strand DNA oligonucleotide
aaaggtacctgcatttaacagtgtgcatgtg

SEQ ID NO: 15036 - DNA, 31 bp, Artificial Sequence
  Single strand DNA oligonucleotide
aaaaggcctttcaaactttgccgaagattac

SEQ ID NO: 15037 - DNA, 31 bp, Artificial Sequence
  Single strand DNA oligonucleotide
aaaggtacctggcattactactgcacaaatc

SEQ ID NO: 15038 - DNA, 36 bp, Artificial Sequence
  Single strand DNA oligonucleotide
tttggtacctcacaatcacaatttggaactagcatc

SEQ ID NO: 15039 - DNA, 35 bp, Artificial Sequence
  Single strand DNA oligonucleotide
aaagaattcctattcactcacgaataactcaacag

SEQ ID NO: 15040 - DNA, 31 bp, Artificial Sequence
  Single strand DNA oligonucleotide
aaaggtaccagcttgttgtgactgtatcagg

SEQ ID NO: 15041 - DNA, 31 bp, Artificial Sequence
  Single strand DNA oligonucleotide
aaaggatcctgaaatggaagctgaacaagta

SEQ ID NO: 15042 - DNA, 31 bp, Artificial Sequence
  Single strand DNA oligonucleotide
aaaggtaccattggatttactccacccatag

SEQ ID NO: 15043 - DNA, 32 bp, Artificial Sequence
  Single strand DNA oligonucleotide
aaaggtaccccacgtttctatgctaccctacc

SEQ ID NO: 15044 - DNA, 32 bp, Artificial Sequence
  Single strand DNA oligonucleotide
aaaggtacccatccaaatccctcctttattac

SEQ ID NO: 15045 - DNA, 31 bp, Artificial Sequence
  Single strand DNA oligonucleotide
aaaaggcctacacacctacacgacaagtttc

SEQ ID NO: 15046 - DNA, 34 bp, Artificial Sequence
  Single strand DNA oligonucleotide
aaaggtaccctacacccttcgataacaagaacag

SEQ ID NO: 15047 - DNA, 35 bp, Artificial Sequence
  Single strand DNA oligonucleotide
aaaggatcccatcaagtaacgaataaactgaagag

SEQ ID NO: 15048 - DNA, 31 bp, Artificial Sequence
  Single strand DNA oligonucleotide
aaagaattctatcacaacatgtttacccagc

SEQ ID NO: 15049 - DNA, 37 bp, Artificial Sequence
  Single strand DNA oligonucleotide
tttaggccttcacactcatatccaaatatcagaagtg

SEQ ID NO: 15050 - DNA, 33 bp, Artificial Sequence
  Single strand DNA oligonucleotide
aaaggatccttctgtacaactaccaacacacag

SEQ ID NO: 15051 - DNA, 31 bp, Artificial Sequence
  Single strand DNA oligonucleotide
aaagaattcaaagaacattgctcatctggtc

SEQ ID NO: 15052 - DNA, 36 bp, Artificial Sequence
  Single strand DNA oligonucleotide
aaaggtaccctagtctctcctctctacgaacacaag

SEQ ID NO: 15053 - DNA, 30 bp, Artificial Sequence
  Single strand DNA oligonucleotide
aaaggtaccctcttgacacagtggatgttg

SEQ ID NO: 15054 - DNA, 31 bp, Artificial Sequence
  Single strand DNA oligonucleotide
aaaggtaccattgcagttgcagccatttaag

SEQ ID NO: 15055 - DNA, 32 bp, Artificial Sequence
  Single strand DNA oligonucleotide
aaaggtaccctaccatgtgaccaaagcctctc

SEQ ID NO: 15056 - DNA, 31 bp, Artificial Sequence
  Single strand DNA oligonucleotide
aaaggtaccaagtatccctccctttcacacc

SEQ ID NO: 15057 - DNA, 33 bp, Artificial Sequence
  Single strand DNA oligonucleotide
aaagaattcctaacaaatcacacaggagcatgg

SEQ ID NO: 15058 - DNA, 31 bp, Artificial Sequence
  Single strand DNA oligonucleotide
aaaggtacctaagccatcataacccaaactc

SEQ ID NO: 15059 - DNA, 31 bp, Artificial Sequence
  Single strand DNA oligonucleotide
aaaggtaccgacaaattaaccaaaccaaacc

SEQ ID NO: 15060 - DNA, 32 bp, Artificial Sequence
  Single strand DNA oligonucleotide
aaaggtaccgtcctgtcagtaccctaaggagc

SEQ ID NO: 15061 - DNA, 31 bp, Artificial Sequence
  Single strand DNA oligonucleotide
aaaggtaccatcgatgagaaccctcacaaag

SEQ ID NO: 15062 - DNA, 31 bp, Artificial Sequence
  Single strand DNA oligonucleotide
aaagaattctaggcctactacataggcggtg

SEQ ID NO: 15063 - DNA, 31 bp, Artificial Sequence
  Single strand DNA oligonucleotide
aaaggtaccgaaaccagcgttctgatctctc

SEQ ID NO: 15064 - DNA, 34 bp, Artificial Sequence
  Single strand DNA oligonucleotide
aaaggtaccgctctataagttcagaaggtggagg

SEQ ID NO: 15065 - DNA, 31 bp, Artificial Sequence
  Single strand DNA oligonucleotide
aaaggtacccacacattcacggtggtacaag

SEQ ID NO: 15066 - DNA, 35 bp, Artificial Sequence
  Single strand DNA oligonucleotide
aaaggtaccgtgaagctcttattttaatttgtacg

SEQ ID NO: 15067 - DNA, 31 bp, Artificial Sequence
  Single strand DNA oligonucleotide
aaaggatccagacctcagcctaagtcacaag

SEQ ID NO: 15068 - DNA, 31 bp, Artificial Sequence
  Single strand DNA oligonucleotide
aaagaattcttaacttgcaaactgcctacac
